United States Patent 10,233,495 (METHODS AND COMPOSITIONS FOR SCREENING AND TREATING DEVELOPMENTAL DISORDERS) - sequence listing, part 18

SEQ ID NO: 69 - DNA, 1806374 bp, Homo sapiens
  misc_feature (1018079)..(1118078): n is a, c, g, or t
gtggcttactgcagtttaaactatgagaactcactctaaaaacagatgtaaacagggctaatattctgcttcctgtgttgtgacctctgcttccacatttaggtttcttttggcaccactttccttaggtaatttctctccataaagtcctgtagagagggtatggagttttgctcttgtcgcccaggctggagtgtggtggtgtaatttcggcttactgcaacctccatctcctgggttcaagcgattctcctgcctcagcctcctcagtagctgggattacaggcacctgccaccacgcccagctaatttttctatttttagtacagacaggatttctccatgttggccaggctggtcttaaacttctgacctcaggtgatccacccgcctcagcctcccaaagtgctgggattataggcgtgagccaccttgcccagcctgtaatcttattttttatatatatatatatatatatatatatatatatatatatatatatatatatatatgaaactttattatatatatatatgaaactttatttcatatatatataatctccaactttatttctagtttatcaatatgccgatttttaaattcatcaatatgcccatcatgattctttctgagaaacattgaacatggattcttcttcttaactctctcaagttcctcctccctgtggcccagcactctggccagcatcctcccccaccccgcactgtcttcccctcccctaccttgccctcactggcccagggtgcttgttcatctccccttcttcctcttcaaacctgactccttcttcaagactcagctctagctctatgtagaagatgaagcccctccttgacccttcctcccttcaaattctctacatctctttaatctatgttgtagaatttagcacctaattatattctgacttcaattatttatagttgttacatgcaaatagtggtaaacgatgcctcataccacagtgacctacttgtgcccgccacctgatgctttatccacattaggcacttaattaatgtggactgagtgactggcccatggattgatagcaagcacttagcaaaaccttgacctgatgttttacaagactctttattgtgcattttattcagaccactgaaaatgcagcgaaaggggcacttatgcctgacttcaaaaagattggtagaaatgatgcttttcccaagagcattactcccccttacagcatatctgtttcagtatctgttttgggaatttcaaagtgatttgttatctgtttgtgagatttctatccatccagggcttggcacctaaaatgggcacatctatgaaatatcaaaggaagaataatttcaaaccacatgagatattctcacaagttgggtaaattgcacatccttagggcacttggtcccttagatcggttatttatgttttacataatttatttcaagtacaggtttttagcatatactttcaagcattttggaaatattctttaacagtcactattctagtcaattgattttaagtcagaaaatatgtccttggtccccacgatgctccagctgctgtgctgggagttaggaacagagacttcagcagacgcatggctcctgctctcaggaaattcacacgacgttggagagtcagaagggtctccaagaaaactcagtgcacattgcaactgcttgacagagtgacagcacatgctgtggccattgcggggactctgctatggcagatcagagggtggtgggtggctccatctctgtctgtcggagctgggctttgtggctgatgaaactgttccctattaacaagacgttaaaacaacatttatggaaaatgcatcgtaggtagtaggcgaggtgctttcttatgaaatgtgggttcttgattttgactgaacatcaggggaaactgtcttcagtcaaaaaaaaaaaaaacaccaaaaaaccagacttgtcactgcgttaagacaaagcacttaaaacctcatcatatctgtcctaccatggggacaatgatgaggaagccattggcacaaattcactgcattccttctgggaaagagctcttccacctgctgtgcacctaagcctttgcagtcatgaacgcaagtgcaattgcaggcaggcctccagctcaccatcctaccatccctctgttgtgagctcggatgtgttcttcagccggtcaaggaatcatggcttgaaaagaagggaaactcttagggcatttgggaaccagaggagtaaggtgggggtgaggccagaagggaggagaacagagctatgggcaaaggttggttttcccgtttccttttctagtgtcttcctagtagagtctccacattaagtagtttgttgattttgtgggcccctggtgtgttactggcccacgtcacaggggaagtgagcaaagctgaccagaagggcaaagctccttgaagctctttccaatgggcttccctgcatgtcccatatccctccaaccccagacaccagcaccttctgcttctgtaatccagtagtcaacaaggagaatatctgatgtaaccacttcagagtgaggcctaagcaactctctgtgttaccctcccagggtcaacatggcctatttgtgagagtaacataatattggtgagatgtgtggcagtggaaaccctttaacactgtctacctcatttgcagcttattgtcacatggaggagtatggaatgcagacatgactgtcactattctgtgtatgggtaaactgaggtgctggtggtcacaggccacctataaccctgttggaaacattttcactgtattacagctcattcccacaattcattaaggcacagacaagattatttttgcttttaactgtttttttttttaatttcagcttttactttgcattcagggaggacatgggcagctttgttatatgagtatattgcatgatactgaggtttgtggtacaaatgattctgtcatccaggttgtgaatagtaacatacagtaggcagtttttcagctcttccccccttgctccctctctcttacctttgtggtccacagtgtctatcgctcccatctttatgttcatgtgtacccagtgtttaggtcccacttataagtaagaatatgcagtatctgattttctgcttctgaattaatttgcttaggataacagcctccagctacattcatgttgctgcaaaagacatgattatgtttttttaatggctgtatagtatttcatggcgtatatataccatattttctttatccaatccactattgatgggcatctgtgttgatttcatgtctttgctattatgaatagtactgcgatgaacatatgaaaaggtgctgatgttgacattggcctgtgggaggcacagggaaagccttcggctcacacctcggagtcactatcactaagtagaggctcaaatggaacctgttctcctacggctaatgaagacaactgcccatgtgatgtctcctgtagttcataatgagacgatgtattagtctgtgttcacactgctgataaagacatatccaagactgggaagaaaaagagtttaattggacttacagttcacatggctggggaggcctcagaatcagggcgggaggtgaaaggcacttcttacatggcggcaacaagagaaaaatgaggaagatgtgaaagtagaaagccctgataaaaccattcaatctcatgagacttattaccacaagaacagtatgggggaaactgcccccatgattcaaattatctcccacagggtccctcccacaacatgtgggaattatgggagtaaaattcaagatgagatttgggtggggacacagaaccatatcattctgcccctggcccctccaaatctcatgtcctcatatttcaaaaccaatcatgccttcccagcagtcccccaaagtcttaactcatttcagcattagcccaaaactccacagtccaaagtctcatctgagtaccttttgcctgtgagcttgtaaaatcgaaagcaagctagttactttctacatacaatgcgggtacaggtattgggtaaaaatggctgttccaaatgggagaaattggccaaaacaaagggattacagggcccatgcaagtctgaaatccagtagggtagtcaaattttaaggctccaaaatgatctcctttgactccatgtctcacatccaggttacgctgatgcaagaggtaggttcctatagtcttgggaagctctacccttgtggctttgcagggtatagccccctcccagttgctttcacaggctggcattgagtgtctgtggcttttccagatgcacagtgaaagctgttggtggatctactactctggggtctggaggacagtggccctattctcacagcttcactaggcggtgccccagtagggactctgtgtggagcctccaactccacatttcccttccacactgccccagcagaagttctccatgagggccccaccccagcagcaaacttttgcttgggcatccagacgtttccatacatcttttgaaatctaggtggaggttcccagacctcaattcttgacttctgtgcacctgcaggctcaataccacatgacagctgccaaggtgttaggccttgcaccctctgaaaccatggaccaaaccgtaccttgccccattttagcaatagctggagcagctgggatgcagggcatccagtccctaggctgcacacagcatgggaccctgggctcagcccacaaaaccattttttcctcctaggcttccaagtctgtggtgggaggggttgctgtgaagacctctgtcgtgcccttgagacttttttcccattttcttgggaattaacacttggctccttgtttcttatgcaaatttctgcagccagcttgaatttctcctcaaaaaatgtgtttttcttttctactgcattgtcagcctgcaaaatttctgaacttttatgctctgtttcccttttaaaactgaatacttttaacagcacccaagccacctcttgaatgctttgcttcttagaagtttcttccaccggatgccctaaatcatctctctcaagttcaaagttccacaaatctctagggcaggggcaaaatgctgccagtctctttgctaaaacataacaagagtcacctttgctccagttcccaacaagttccttatctccatctgagaccaccgcagcctggatttcatcatccatatcattatcagcattttggccaaagccattcgacaagtctctagggagttccagactttcccacatgttcctgtcttcttctgagccctccaaactgttccaatctctgcctgttacccagttccaaagttgcttccacatttttgggtatcttttcagcagcaccccactctactggtaccaatttactatattagttcattttcacactgctgataatgacatacccgagactgggaagaaaaagaggtttaattggacttacagttcacatggctggtgaggcctcagaatcatggcaggaggtgaaagacacttcttacatggtggtggcaagagaaaaatgaggaagatgcaaaggtagaaatccctgatgaaaccgtcagctctcatgagacttattcactatcacaaggacagtatgggggaaatggctcccatgattcaattacctcccaccgcatccctcccacaacacatgaaaattatgggtgtacaattgaagatgagatttgggtggggacacagagtcaaaccatatcagaccccttgttgtgcttccaaatatttaataaaataaaacccccccaaaaagaagaagaaaagaaaaggcaagacaaccagactactcagtaggctgctcagagccacatgagagaagatcattttcaaaatcggcttctgcacattttctctttggatccattttcctttcagggaagagcaccctcatagcagagtggccacctttgcttgttaaacacaagagccaggaaatcactttccaacgctaccccctgtttagtgctctgtttagtattaaccagaatcctctgaaaaatcatatgtaatctcagcattcccaagaagtatgtagtttttgttttcttgtttctcttaaattgtgtcatggatgataatattcctgcaaaacttagcaagtgaaataatttccttaataaccttccccctttctatctaaggaacagtatttcttttgttaacaggtttattaaagggcaataatatttggcatttctttcaggactttttcttaagataaaggatttgaaccaagaaaagataatgaccgtgggaaaaccctagtgtgacttcagccccattcaacacaaggcattaaccaagcacctactgtgtggggtgccagatgaaggctaaagtggaggttaacactgagatgtgtgagcctctggtgataggacctggttgtttctgttggctgggaaccaacctctcctgtgagagatagggcagcctcttcacatagtgcatggccaccacaactaaacatttctctcttatttctgcttccaaatttctatcatttaagccattattttccgttaaggtggaaaatacactccttttaagctgaagcaccccaccactaggaggatggctcttttgagatttgcagggtccctctcaggtacccctcaggcttcctcctgcagcccctgcttaccgagggcatctgctgctgaggaaatcagctcccggcacctggtttatgatctaatgtacaagatgcaacagggacgtgggcttctgcgggtatgagtgcaatgaaattcaaacacgacttccaaatctgtttcttgatcctagtgtgtgggtcagctccaggccaggaacaatgaagggagagatgagcaaacaaataaacaacaaaaaccgcccaaaacaaacacacacacaaaacaaatagaaatgaagtccatgtgcaaagacttggcagacacagccattgagccaaaggctattttccccaaagatgaattcttgccttcataaggcaaggaatagcagcaggcatttacataaagcgaataaactggcactgttaagttccaggacacgtcctggggcttagcctcctttcatttattcagcctaattcccaccggtgacagctaccaccatgtttagggctgtgatgccagcatcccaaagggtcactggattttggctttgatgtcccaacacagaagagaagattcaagcactgtcaacaaaaatatttgtctaaagactagatcaatcaaaatgttcacttaaccagaaggtcaacctactcaggcccccatttctatataccacagatgcctttggttttgaacagtagaagtctaacatctccagtaaagcctcattgctaactagaaattatcatgtctcacaggacagcgcaatacagaaaaaatggcattttccattgacataattattgtggtttattttcagggacataaattgtaacgattcaactgataaatttaatacaacttaaaattgcatgtagtcaccatagacggtggcataagcaaggatcattagagaaaatgcaagtctttagccatttcaaactccacactgttttgttgttgttgcttttagtccaaggagcattgctcaaattaaattttaggtgacattattaaaacaagctctctttttgtttgtttgtgcctaaagctttctgtatctgtggccatgaccctatcattgccccagtctcttggaggggttttgggatgttcttaagcataacttaatccactggcttagctttggagaactgtgaaggacctttgagatcatgggttccagaaaggggctgccaaatggcatggccagctctgccacttacaagtagtgggaccttgcaagttacctcacttctccgttcccatcttacaactaacaagacgaagtcacagggttacgtgagatttctcacgaaaggactaggaagcatctcaacgagattaggtgctcaataactttccattattattaaggaggaaagagggataaatatttcaatggcacaaaagctcccaacagcatgggtcattatgtgagatgcagtaaaaacacaacttgatagagagactatcccctctggaaactcctaagtttcaaattctgtaagtttgaaattgtttaaaattagcaatggttacacatgaataataaaatgaatggttacacatgaagtaatttgttaccttcaagttgacatttttaaaattttatgtatacattttaaggtggcagatagatttaaccagatgtttactgcattccttttcacaggatctgtctacaggctaagacaagcaaacatgcttaagtgagacacatgactaagatataagaccactcagaagctctttgcaaggaagcctttaggaccagaaacttgtgtttcaggaatggagatgtgagtcctttgattttgggtgtgctctctgaggtgtgcacacaaatcacagaaggttttgtttttgttagtcacttttgcaagagattataacctatgagtcactggctcattaattaaactttagagcaacccagtgaagttccaaaatgttaacaaaagtcactgacaccaagggtaagatgcttgagctttttcatcttttcttgtcctacacaaaagcatgaacaagatgtcatttaaggatgttaataatcacaactgtgaagagcttgggaagaagactaaccacaggagctcttctaccaggaacccacatcatgcactgggacatcttgtccaccctttgacccagttttcccgtgaaggaaatggacatgatccaggattctaagtggagacacagccccttggagggaatagctacattacaataaggtttctttctttcccaccactcctctgatgtccatttgtctctgtgtagagagaggtccctttaaaacctcactatagagagcttggggagagacggcttctgtttctgtctccaggcaggcctactagcaatgctacatgagcagcagagccctgcacagcacatttcaaccgtgtctagcaccctcactctccttttctgctgtgtttgttctgaatagcatcatcgctatctgacattataaaacgtagctgtttgttcatgttttcatactgtctctttcctcactagaatataagctttgggagagtaggggtgtattgtatttgctaatacctaagatgcttggtgcgcagacacacacaataaatcgttttttaatattgccctcattctttcacttgcagtttgattgtgagccatttgtctatagaataaagggagcccatcctttgctttttgattgtttgtttttgctgaaatcagagcaagtgcattagtctaagcaaaaaggagagcccggggacttggaagagtctgttggggaaagagagaagaggcaaagtggtgatttcctcttttacatatttttctgagtggagaggaatttctcttgaatctcaaggaggctcatacagtggaaagccttcttctgtctatctgggtggtcggccagccagcggggctcagagcagccttggccaaacatttgcaaaataggaaattaatttttgaattctctgaaacatttttcctttgtgagaactgtagcagcaacatattttaatttgcatttgaatatactgctttttaaaaattatatcagttatccttttaatagtaggtatataaatcactataaaacctaccattaaaaaaggaattcaaaattaaaagcaaaatgaatacttagtatagccactctggagaatagtatagtggttcctcaaaaaattataagtagaactgacacataatccagcaattccactgctgtgtatgtatccaaaagaaagggaattagtatattaaagagatatctccactccactgtgtgctgcagcactctttacaacagccaagacatggaatcaacctaagtgttcatcagtgaatgaatggataaacacaatgtggtacatgtacacagtggaatgttatttttttactcagccataaaaacaaatgaaatcttgtcatttgcaacaagaatgaaactggatgacactatgataagtgaaataagccaggcatggaaaagtatgttgcatactctcgttaatatgtgggagataaaaaaaattgaactcatgaagatatagaatggaacgatgactaccagaggctaggaagggtggtgagagagagagagataaagagaagatggttaatgggcacaaaaatatagttagaaaaataagatttaatggttggataactataggtcatcacaataggatgactatcatggtaatttatggtacatttcaaaacaaagagtggaattggaatgctcctaacaaaaataaatgataaacacccttgaagtgatagattcccccagttaccctgatgtgctcttgcacattgtatgcttgtatcaaaatattacatggacccccaaatatatacaaaaattatgtatttatgaataatatttcataagaatataattaataatcactattaatgaaaacatttccaataaaataaaataaaaggtaactcttagtccaaaaaaggtaaatccaagcaaaaaaatgttattcaaatgggtaactatactaaaattatcaaattctggatttgtttgctaccgatatgaaaaggtgttgtattaatacatggaaataatatctgaggtctcctcatgattcttctaaatctcttcctccttttctcaccccaacatttgtttcctttttccattcttccaccttcctctacagaactctgtcctccagaatggttctgtcaatcctagtagagaggttgctgcttggaggggagacgtggctgctctcaaacaagagcgaggccccacctctggtgtgtcggccagcagcctctcacctcagacatcgtgcagaccactcaccacctgcagtccccacaggaacagcataaatcctcaacattattaccagttaacacataaaacagatcccagggagatagaggaagagaaaaataaacattgattcagaatgtcaggagcactggtcagttttaagtggccatgatgcctgtggggagaagcggtaaccctgcagttatcgggcaagaggaaggcctccaggaggccagaggccaaagagcaaatgaaccacccaagaggtgagaagcaccaaccagcttgcctattgaagattataaaggctaactttgggctttatttcttcttgttttggttccttgaggggtgaagttaggttgcttttttgccatctttcttttttgaaaaatatggccaggcgcagtggctcacacctgtaatcctagcactttgggaggccaagacgggtggatcatgaggtcaggaattcaagaccaacctggccaatatgatgagacccctgtctactaaaaaacaaacaaacaaacagacaaaaaacaaaaattagctgggcgtggttgtgcatgcctgtagtcccagctactcaggaggctgaggcagaagaattgcttgaaaccaggaggtggaggttgcagtgagctgagattgcaccactgcactccagcctgggagacagagtaagactccatctcaaaaaacaaacgaacagaaaatatatagggatttacttatgtgaacttccctttattattgcttttgctacatcctataagttttgataagttgtggtttcattttcatttatctcaaaacatttctgatttcccttttgatttcttctttgactcattcattgtttaagaatgtatttttaattcctacatattttttaattttccaattttccttctgtcattgatttatagtttcataccattggaaaaggtacttggtatatattagtctgttttgcactgctacagaggaatatctgaggctgggtaatttgtaaagaaaagagattttttggctcacggttctgcaagctgtataagaagcatgacacatctgcctctggcgagagtctcaggctgcctccactcatggcgaaaggccaagggaagcagcacacgcagagttcatgtagcaagaggatgcaagagggagggaagggggatgtcaggttgtttttaacaatcagctctcacataaactaacagagtgagaactcactcattaccacaggaagggcatcaagtaattcatgaggaatttgccccatgacccaaacacctcccattcggctccacctccaacactgaggctctcatttcaacatgagatttggaagggacaaacatccaaactatatcatggcatggttttaatcttgtttaattttttgagacttgttttgtggcctaacacttgatctaccctggagactgttctgtgtgcactagagaagaatgtgtattctgcggctgttggatggaatgttctgtaaatgtctcttaggtccatttatctatagtcttgttcgagtccactttttgcttatcgattttatgtttgggtgttctacacattattcaaagtgcgctactgaagtctctgatatcgttgtgctgctgtctatttctccagttctgtcaatatttgttttatatatttaggtgctttcgtgttgatatatacatttatgattgttcaatcttcctgatgaattgattcttttatcattatacaatgttgtattagtctgttcccatgctgctaataaagccataactgaaaactgggtagtttataaatgaaataggtttaattgactcacagttcagcattgcagggggaggggcctcaggaaacttgcaatcatggtggaaggggaagcaaacacacccttcttcacatggcgacagggaggagatgtgtagcgcaaagtgggaaaagtcccttatagcaccatcagatcttgtgagaactcactcactatcatgagaacaacatgagagtaactgctcccatgattaaattacctcgcactggggccttcccatgacacatggggattatgggaactacaattcaagatgagatttgggtcacagccaaaccatattattccacccctggcccctcccaagtctcatgtctttacatttcaaaacacaatcatgcttttccaacagtcccccaaagtcttatctcattccagccttaaccgaaaagtccaagtccaaagtcacatctgagacaaggcaagtcccttctgcctatgaccctgtacaatcaaaagcaagttagttatgtcctacatacaatgggggtacaggcattgggtaaatacacctgttccaaatgggataaattagccaaaacaaagaggctacaggcaccatgcaagtatgaaatccaatagggaagttaattaaaacttaaagttccaaaatgatctcctttgatttcatatctcacatgcagatctcgctgatgcaagagttgagcccccatggccttgggcagctccaaccctgtggctttgcagggtataggccctctcctggctgctttcatgggctgatgttgagtgtccctggcttttctagatgcagagtgtaagctgttggtggagctaccattctgggttctggaggaaggtggccctcttctcacagctccactaggtggtgccccagtagggactctgtgtgggggctccgaccccacatttcccttccacactgccctagtaaagttcctccatgagggctccacccctgcatcaaacgtctgccttgacatccaggtgtttacatacatcctctgaaatctggttggaggtttccagtcctcaattcttgacttctgtgaacccacaggcccaacaccttgtgtaagctgccaaggcttggggtttgcattccatgaagcaatggcctgagctgtatgttaaccctttttaaccatggctggaatgaagggcaccaagttctgagactccacaaagcagcaaggccccgggcctggcctatgaaaccaattttccctcctaggcctcctggcctgtgatgggaggggctgctgtgtagacctctgacatgccctggagacattttcccccattgtcttggtgattaacattaggcttctcattacttatgcaaatttctgcagctggctttaatttctccccaggaaatgggtttttcttttctattgcatcatcagactgcaaagttttcaaacttttataatcttcttttgaagttttgtcgcttataaatttcttccaccagataccctaaatcttctctctcaagtcaaaagttccacagatctctagggcaggggcaaaatgccaccagtctctttgctgaaacatagcaagagttacctttattccagttcccaacaagttcctcatctccatctgagaccacctgaacctggacttcattgtccatatcactatcagcactttggtcaaagccatttgacaagtctctaggaagttccacactttcccacatcttgctgtcttttgagccctccaagcctctaggaagttccagactttctcacattttcctgtcttcttctgagcccttcaaattgttccaatttctgcctgctacccagttccaaagtcacttccacattttcaggtacgcttacagcagtgccccactacccagtaccagtttattgtattagtctgttctcacgctgctgtaattaactgcctgagactgggtaacttacaaaggaaagaagtttaattgatcacagttttgtatggttggggaggcctcaggaaatttacaattatggcagaaggggaagcaaacatgttcttcttcacatggcagtaggaagcagaagtgccaagtaatatgatttggctgtgcccccacccaaatctcatcttgaaacttgctcccataatttccacatcatgggaagtaattgaatcatgggggaaggtctttcccatgctgttcttgttatagagaataagtctcatgagatctgatggttttataaaggggagttccccagcacatgttctgttgccagacatcactttgctcttcattcactttctgccatgattgtgaggcctcctctgccatgtggaactgtgagcccattaaacctctttttcattataaattcttcagtctcaggtatgtctttattagcagtgtgagaacaaactaatacagtaaaatggtaccagtagagtggggcgtgctgaaaagatacccagaaatgtggaagtgactttggaactgggtaacaatcagaggttggaacagtttgaagggcttggaagaagacaggaagatctgagaaagtttgaaacttcctaaggacgtgttggatgtctttgacaaaaatgctggtagtgataaggacaataaagtccaggctgaggtggtctcaggtggagatgaggaacttgttaggaactggagtaaaggtgttatagcaaagagactagtggcattttgcgcctgccctagagatttgtggaacattcaccttgagatagatgagttagggcatctggcagaagaaatttctaagcagcaaagcattcaagaggtggcttgtgtgctattagaagcattcagttttatgtattcccaaagatacggtttggaattagaactgatgtttgaaaggaaagcagagagtaaatgtttggaaaatttacagcctgatgaagagatagaaaagaaaaccccattttctgagaagaaatttaagccagctgcagaaatttgcataagtaacaaggagccaaatgttaatcaccaagacaatgaggaagatgtcttcaggacatgtcaaaggtcttcacagcagcctctcccatcacaggcctggaggcctaggagggaaaaatgccctgcatccaaggtgcttcagctccagctgtggctaaaaggggccaaggtacagctcaggccatggcttcagaggatgtaagccccaagccttggcagcttacttggggttttgagcctgtgggggcacagaagtcaagaataaaagtttgggaacttcttcctagatttcagaggatgtatagaaatgtctggatatccagccaaaagtttgttgcagaggcagtgctctcgtgaacctctgctaggacagtgtggaagggaaatgtggggtcagagctcccatacagggtccctgctggattatagcctagtagagctctgagaagagggccagcatcctccagaccccagaaaggtacatccacttacagtttgcaacatgcacctggaaaacccattgacactcaatgccagctaagaaagcaactaggaaggaggctgtgcccttcaaagccacaggggagaatctgcccaaggccataggagcccacctcttgcatcagcatgacctgtatgtaagacatggtgtcaaaggagattattttggagctttaaggttaatgactggcccactggatttcagactttcttggagcctgtagcccttttcttttggacaatttcttccatttggaatgggtatatttacccaatgcctatactcctattgtatctagaaagtaactaacttgcttttgattttacaggatcacaggcagaagggacttgccttgtctcaggtgagagtttggactgttgacttttgagtaaatgctcaaatgagtaaagatgttgggggactgttgggaaggaatgattggttttgaaatgcgaagacatgagacttgggtcgatcaagggcagaatgatatggtttgactatgtccccaccaaatctcatctttaattgtatgtaactctcataattcccacatgttgtgggagggaccaaattggaggtaattgaatcacaggagcaggtcttacccatgctgttcttgtgacagtgactaagtctcatgagatctgatgattttataaaggggggttctcctgcatacactctcttgcctgccagcatatcagatgtgagtttgctcctcattcgtcttccaccatgattgtgaggcctccccagccatgtggaactaactgtgagtccattaaacctctttccattataaattatccagtctcgggtatgtctttattagcagtgtgagaacagactaatatgccgaataaaggggtaaagcctcttataaaatgatcagatctggtgagaactcactatcttgaaaactgcacaggggtaaccaccccctttattcaattacctcccaccaggtccctcccatgacacgtggggattatgggaactacaattcacgatgagatttgggtgaggacacagccaatccatatcaaatgtccatctttgttctacttgttattgagcattttgtgcacttcctacatgttttgggtaaaatactaaaattctgttgtctgttggggttaatatataaatggagtaagtgggttataattctactgatgtcactaactagctttgcaacattgaagaagctacagtgccactttaatgcttagcttgctcatttgtcagagtatttacatggcagcattgccttttttttttttttttttgagatggagtctcgctctgtcacccaggctggagtgcagtggtgcaatctcagctcactgcaagctccacctcctgggttcatgccattctcctgcctcagcctcctgaatagctgggactacaggagcccgccactgtgccaggctaattgtatttttagtagagacagggtttcaccatgttagccaggatggtttcaatctcctgaccttgggatctgccacctcagcctcccaaagtgctgggattacaagcatgaaccatcacacccggcctgcctttttttataattatgatgtgaatttctcctgatctgggtgaagttaggtgaatttacttgttgtagagaaattgaacaaagtctctcccatggtgacatcaaagactatggtgctaacattattatttgaaggacaactttattatatttataaaaatgatacatgctcactataaaacactcaggcaataaaaaaaagtataaagaataaattttctctaatcctcaaaaatagtgttgttatttggtaaatgtcatctcagatatttctcttcacagatatataatagaaggatgaagaggaagagaaagaaatttctaagtatggattcagaccatattatttttaattttaaaagtattacatttaatagcttttaattctatccaagagagaaaatgttacggaagagttgaaattcagattaatatttattcctcctttagaaactagtttctataaatttgctcaaagcctaggaaagattagagaatgagatacctcttatgcactacttagatctttacagcctcacttgtcccctgctgcagccttgcattgtctcacagcaattttataaagatacaacctgctacgctgggcatttcttctcccaatctgggtttccctgtggctttcactatgggaacccacttagcacagagttgactcaaaagtgcagaggagttaacacccaggggaagactttttaactaatgggaaattagagttaaattattcctactttctccacagtctctagcagtatgatcttaagatggaattttcatgcttcttggggtcacattcccataaatcaagcaagcattcacacttagcagtggctcacctgacaactcacctgtacactgcctcctcctaccttgcccactccatttgttgtattccttactccagcttctggaattgtacttcctcaaatagtaatagctcatcagccccacctccatttttatgctctaaaattaattgaattcattctaaataactaattgaattcattctaaaatattggcactagaaatggcactcctaaaatatttagattattaggaaaacagcctgtcaaaatgatgttttggtatttttgagctcattactggcaagaaagatcccagtgctggtggtaagaggaatggtgttctcaatccctatcatccacggaattgcctgtggttaatcggaataaggtacagttggaagatgaggcattggaatgtgtggggattgcaatgtgtagtattaggaaagctaatgtttataaggactgtggagtggtccagcctcattaatgacattggaaacatttcaaaaaataagtagtagggtcagggcatcaaaattctaacttaagacactctgtgaaagccaaagggccttgataacattagtttggaagattttcacctcctgtagttttacgataaactttgtagatgaagttcacaatcacaccgtaaagtgttgggctgcaaaaaagacagaatgcagtccatacaggtcactaattagaaaaatcatgagaaccagaagcctgggagggggacactgaatgatatggtttggctatgtccccacccaaatctcttcttgacttatagcctcataactcccacatattgtgagagggacccagtgggagataattgaatcatggggccagtttcccccatactgttcttgtagtagtaaataaatctcatgaaatctagtggttttataagaagtttcttctatcacttggctttcattctctcttgactgccaccatgtaagacatgcctttcaccttctaccatgattgtgaggccttcccagccacatggaattctgagtcttttaaacctctttttctttatgaattatccagtctcaggtatgtcttgatcagcagtgtgaaaatggactcatacagtaaattggtactggtagagtggggtgctgctgtaaagatacatgaaaatgtgaaggtgactttggaactgggtaacaggcagacgttggaacagtttggagggctcagaagaagacaggaagatgtgggaaagtttggaacttcctgaagacttgttgaatggctttgaccaaaatgctgataatatgcacaatcaaatccaggctgaggtggtctcagatagagatgaggaacttgttggaaactaaagtaaaggtgattcttgccatgtttaagcaaagagactggtggcattttgctccatcctatagatttgtggaactctgaacttgagggagatgatttaaggtatctggcagaagtaaattctaagcaacaaagcattcaagaggtggtttgggtgctgttaaaagaattcagttttaaaagggaaacagagcataacagtttgaaaaatatgacctggcacagtggctcacgcctgtaatcctagcactttgggaggccaaggtgggtggatcatgaggtcaggagttcaagaccagcttggccaatattgtgaaaccccatctctactacaaatataaaaattagccaggtgtggtggcacatgcctatagtcccagctacttggcaggctgaggcaggagaattggttgaacccaggaggtggaggttgcattgagctgagattgcaccactgcactccagcctgggcgacagagcaagactccatctcaaaaaaaaaaaaaaaaagaaaagaaaaaaaaagaaaaagaaaaaagaaaaaaaattggaaaatttgcagcctgatgaagcaatagaaaagaaaaacgcattttcccagaagaaatttaagctggctgcagaaattcacataagtaacagggaaccaaatgttaatgctaagacaatggggaaaatgtctcaagggcatgtcagagatctttgaggcagcccctcccaccacaggcctggaggcctaggaggaaaaaatggtttcatgggctgggtgaaggacttccctgttgtgtgcagcctagggacttggtgccctgcatctcagcctttcagccatggctcaaaggggccaaggtacagctcagcttatagcttcagagggtgcaagccccaagccttggcaggttccatgtggtattgagcctgtgagtacacagaagtcaagaattgccatttgggaatctccacctagatttcagaggatgtatggaaatgcctgaatgtacagggaaaagtttgctgcaggggtgaggctctcatggaaaacttctgctaaggcagtgcagatgggaaatgtggactcgaagccctcatacagagtccccactggggcactgcttagtcgaactgtgagtagaggaccagcatcctccagaccccagaaaggtaatccactgacagcttacaccatgcacctggaaaagccacagacactcaacaccagcccgtgaaagcagctgggagggaggttgtagcctgaagccacaggggcgcagctgcccaagaccatggaaacccaccttttgtatcagtgtaaactggatgtgaaacatggagtcaaagggatcatttttgagctttaagatttgattgcccaactggattttggacttgtatatggcctgtaaccgctttgttttggccaatttcttccatttggaatggctgtatttacctaatgcctgtacccccattttatctaggaagtaactaacttgcttttaattttacaggctcataggaagaagggacttgccttgtctcagatgagactttgactattggcttttgaattaatgctgaaatgagtcagcaggaaaagacgttggaggactgttgggaaggcctgattggttttgaaatgtgaggacatgagatttgggaggggtcatcagtggaattatatggtttggctttgtcctcacccaaatctcatcttgaattatagctctcataactcccatgtgttgtgggagggacctggtagaagatagttgaatgatgagggcagtttccctcatactgttgttgtggtagtgaataagtctcataagatctgatggttttataagaggttttctcctttcacttggatctcattctttcttgcttgccaccatggaagacatgccttttgcctaccaccattattgtgaggcctccccagccaagtagaactgtaagtccattaaacctttctctttataaattacccagtcttgggtatgtctttatcagcagcatgagaacaaactaatacactagataagcctgagattctttaaaccacaaattctttttaaaacgcaaaagttgcactctcctttttgttggagaagggtagcatctccttgcctgaaaaaggcctgaattcacctgaatcaagggcttcacctaagggcacttgatttcactaaagcactggagtctcttaaaggcagaattgatcaaatagaagaaagaattcatgagcgtgaagacaggctatttgaagatacacaatcagaagcaacaaaacaaaaaagaataaaaaagaatgaagtatacccacaagatctagaagatagcctccaaatggcaaattattggccttaaagaaagagttattggccttaaagttattggtttaaaaaaaaaggtattagccttaaagaaaaggtattagccttaaagaaaatgtagagaaagagatagaggtagaaagtttattcaaaggaataataacagagaacttcctaaacctagagaaagataccaatattcaaatacaagaaggttatagaacaccaatccaatttaacccaaaggagactatctcaaggcatttaataatcgaactccaaaaggtcaaagataaagaaaggatcctaaaagcagcaaggaaaatgaacacatagcatacaatggtggtccaatatgtctggcagcagacttctcagtggaaacatttcaggccaggagagagcgacatgactgtttaaggtgttgatggaaaaaacttttaccctagaatagtatattcagcaaaaatgtccttcaagcattaaggagaaatacgtaccttcttggacaaacaaaagctgagggatttcatcaatatcagagcagttctacaagaaatggaaagggagtttttcaagcagaaagaaaaggatgttaatgagtaggagaaatgcaaagggagtttttcaagcagaaaagaaaaggatgttagtgagcaagaagaaatcatctgaaggtacaaaactcactggtaatagtaagcccataggaaaacaaagaatattataatggtgtaattgtaatgcataaactgctcttaagtagaaagactaaataatgaatgaatcaaaaacaataactacaacaaattttcaagacatcgagagtatataatgagacataaatacaagcaacaaagagttaataagtagggggatgtagttaaagtgtagagctgtgattagttttctttttgcatgtatgttgcttatgtaatcagtgttgtcatcagttttaaataatgggttgtttgcaagactcacagtaaccataaattgaaaaacacaaaacagatacacaaaaaattaaaagcaagaaattaaataataacaccagagaaaatcaacttcactaaaagggagataggaatgaaggaaagaaggaagagacaccacaaaacgactaggaaacaaataacaagatggcaggagcaagtctctacttaccaataatagcattgaatgtaaatggactaaacattccagtcaaaaagacagagaatagttgaatggatggaaaaaacaagatccaatggtctcttgcctgcaggaaacacatttcacctataaagataaacatacacttaaaataaaaggatagaaaaaggtgttctatgccaattgaaaccaaaaaaggacagtagtaggtatacttacataagacaaaatagatttctaaacaaaacctgtaagaagagacaaaaaaggttattatataatgataaagggatcaatcctgcaacagaatataacaattataagtatatatgatgaagaaattaagaaggaaattgaaaatttgcttgaaacaaatgataatggaaacacaacataccaaaacatatggaatacggtgaaagcagtagtaaaagggaaatttgtatccataagtgcctgcatcaaaaaggaagaaaaacttcaaataaccccatgatgcatcagaaagaaccaggaaaacaagagcaaaccaaacacaatattagtagaagaaaagaaatcataaagatcagagcaaaaataaataaaattgaaataaaagaaaacaatacaaaagatcaacaaaacaaaaagtttttttaaaaagataaagaaaattgacaaacctttagccagaaaaacaaagaaaaaagggagaaggcccaaataaataaaatcagagatgaaaaaggagacattacaactgataccacagaaattcaaaggatcattatttgtggctactatgagcaactatatgccaataaattggaaagtctaaaggaaatggacaaattcctagacacatacaacctaccaagattgaaccacgaagaaagtcaaaacctgaacagaccaataacaagtcacaagattaaaactgtaataaaaagcctcccagcaacaaaaagcttgggactcgatagcttcactgatgaatttaccaaaaattttaaaaaactaataccaatcctaccaacctattccaaaaaatgaaggaagaaatacttccaaaatcattctatgaagccagtattaccataatactaaaaccaaagacacatcaaaataagaaaatttcaagccaatatctctgatgaatattgatgcaaaaatcctcaacaaaataccagcaaacaaattaaaaaatacattagaaagatcattcatcacgaccaattgggatttatcccagggatgcaaggatagttcaacatacactaatccatcaatgtgatacatcatatcaacagaatgaaggacaaaagccatgtgatccatatgatcaattgaagtgaaaaagaatttgataaaattcaacatctcttcaggataaaaaccatcaaaaaacaggatatagaagaaatataccttaacataagaaaagccatatatggcagacccacagctagtatcatactgaatagagaaaaactgaaatcctctcctctaagatctggaacatgacaaggatgctgtgtcaccacagttattcaacacagtactgcaagtcctagctagagcaatcagacaagagaaaaaataaagggcatccaaattggaaaggaagaagtcaaattatccttgtttgctgatgttataatcttgtatttggaaaaacatcaagactccaccagaaaactattagaactgataaaaaaaattcagtcaagtttcaggatacaaaatcaacacacaaaaattagtagcatttctatatgccaacagtgaacaagaaaccaataaatacaataaccataaataaaattaaatacctaagaattaacttgactaaagaagtgaaaggtctctacaatgaaaactataaaacattgattaaattgaataggacacaaaaaatgaaagatattctatgttcatagattgaaagaatcaatattgttcaaatgtcatactatccaatgcaatctaaagattcgatgcaattcctatcaaaatactaatgactttcttcatgtaaatagaaaaagcaatcctaaaatttatatggaaccacaaaagacccagaaaagccagtcatcctaagcaaacagaaaaaaactgttaactgtttgtctttctgtgcctggcagagtttacttaacagttaatttaattgtacacttgaaaataactaaaagcatataatttgattgtttataacacaaaggaaaaatgcttgaggtgatggataccacatttactctgatgtggtcattatgcattacatgcctatatcaagatatctagtgtatcccagaaatatatacacctactatagtatgtactcacaaaaatttaaaaaatgtccacaatacccaaagtgatctacagattccatgcaatctctatcaaaataccaataacattttttacagaaatagaaaaaaaccataaagttcatatggtatctcaagggacctcaaatagccagtcttacaattttgaaaaactataatacagttggaggtctaacatttctttatttgaaaacaactatgaagcaacagatgtgttgaccaatggaacagaatggagaactcagaaattttgcctttattgccaaatcgttttcaataagggtgccaagactactccatgaggaaaggacagtctcttcaacaaatggtattgggaaaaacggatattcatgtgcaaacggtgaagttttgagtataccatatgcaaaacattaaatggattacagacctaaacataagattaaaaactattaaaatcttggaagaaaaaatagggggaaaacttcaggacattgactttggcaatactttcttggatatgacatgaaatcacaggcaatgaaggcaaaaatagatatactgaaccatatcaaacttatagatgtctgaacatcaaaggaaacaatcaaggaagtgaaaaggcaatctatggagaggaagaaaatatttgaaaaccttctatctgataaaaggttaatatatatatgtccatacatatggaacttctgcagctcagtgacagaaatgcgaataacttgatttaaaagtggacaaaagactcgaatacacgttttcccaaaaaacatatacagtgacccacaagcatatgtaaagatgttcaacatcactaattataagagaaatgcaaatcaaaaccacaatgagatattacttcatactcattagaatggccaccatcaaaagaactgaaaatggtgtttctgaagatatggagacattgcaatccttgtgtacatataatgaaatattatgcagccttaaaaaagagaaaattgtttcacaggatactgcatagatgaacctcaagagcattattctaagcaaaataagtcagtcacaaagggacaaatgctgcaaaagtccactcatatgaaacatctaaagtcatcaaaatcatagacatagaaagtagaaaggggattgtcaaggacgggtggggagtggggaatgagtattcatgagtgtgaagtttcagttttgaaagatgaaaaaattctagataactgtttcacaacatgtgaatatacttaacaccactgaactgcatatttaaaataactacaatggccaatttaatgttgggtgtttattttttacgacaataataaaaaacatataggattctgtaaagtggcatatcctggaggcctttctcttctcttgtagctgtctggataataaataggagttttaattttctccttgcgaattttaaagtgctgctccaaattgcaagttattagggagaattgtaaggatgttggtgattcacctttcctcattactgcttctggggagggcagaatggggatggaacaagatgtggggccacactgagctgtattgggatttttttctttttcttgtctctcttatgtataggactttttttataggtataacatggtacattaggttggatccctttccttgtttgcttattgttatagaaattttttggccgggcgcggtggctcacgcctgtaatcccagcactttgggaggccgagacgggcggatcacgaggtcaggagatcgagaccatcctggctgacacggtgaaaccccgtctctactaaaaatacaaaaattagccgggcatggtggcgcgcgcctgtagtcccagctactcgggaggctgaggcaggagaatggcgtgaacccgggaggcggagcttgcagtgagtcgagatcgcgccactgcgctccagcctgggcggacagagcgaaactccgtctcaaaaaaaaaaaaaaaaaaaaaaaagaaattttttactgggtatttatttatttactagatacttagggaagggaaatgatgtgatccagcttcattctgccattttgactacttcttgtgagcattcttgcatgttatttgatttactaaggaactcattgctgtgacataacttactttatattataaccaatttaatatacattgaacatgtactctgtcccatactctgggcaaagcactgaggctacagagataaataagatacaccgacagttatggtctcaagtttgcacacacctgaacttcttatgttgaaatccaatccccagtataatggtattaggaggtgagacctttgggagataattagatcaggaaggtggagccctaatgaatgggattagtgttcttttaagaagaggccagagagctagttcctcctcttaccactttgagaagtcagaagtctgcaggctggaagagaacacacaccagaacccaactgtgctggcatcttggtctcagacttcctgccttatgtgagaataaatgtccattgtttaagagccagttcaggatcacttgttatgcagtcaagctgactgagacactgactgagtctgtccattctgaaagtggcacagaacagttcagtgtggtgagcacagggaccacatgcaacatccaggcaaggtctgctcaaggtcagcagggagagaagggacgaggactctgttttgaacccaggtttctgggcaggaaggccaggacctgggacccagaggaacatgcgtgtttaacctcgctctgttgcaacagcttgtctctggaaaagattgagtgcaacccacttggagacaagggctcagaaaagtgcactttgtaggtctttctctgtgtgtgactcaaaatagttctttctaaaaaacaggtaataattcctttcaaaatcttaacaacaatgaattagaacagtgataatatcccgtgctgttaggaaaggagaaagggacattctgttcacattactcaaacaactataaattgcttcaatggttttagaaaacaacttgacagaacctattaaagtaaaaatacgcttgcattttgacacagaaaagcacctttggggaatctatcctaccgatataatgccatcagtttataagtctaggtgaataaggttgtttactgaagcattatttatagtgctgacaaaatagagaaacttgtgtatcaactgtcagtacacggaaaatggaatgcatcttagtgcatccatctgtagaatattatgcatcaaggaatgtaataatatagcgttaattgaaaaagacaatttgctgagtgagcaccatgtatgaatggaaaagaagtctttacatttggagtgtgtgtgtggagtgcgtgttctatgtgtctctgtggctatgtgcatttttatgagtatagaaaacagtatggaaggctgtatactaaggtttcaacattgattaccttggagaagggggtagataactagaggaggaggaagaaatcattgtctttgactttgtgattccctgtggtgaattgttgattttgtttgttgcaacaagcaacatgcattacttttgtagtttgaaaggaaaatccaataaggcatgaagaaataaaatacaaatcttaactgtttgtggtcaggggacaaataaggcaggctcagggtttagggaatgccctcacccactgcataactttcaggtcacttcccctggccccttgtgcacatgctcattctgcagcatccagcaggtaccggcagtgtgggtgttcactctgagagcgcccatcagtgtgagagacacttgactgttgcatgtgagttctaggatagtcactctgtcctctgtgaatccatcactcgtgtagagtcctaactctctggaaaggaagcactgaggtaggtaaatggagcacccaggcggggtaatatgttcaatgtcatcacactgtgccttctaagtgacttctgttcctttagcctaaatacagtactccaaaaaacctctgaaacaatttccaggccgggcgcggtggctcacacctgtaatcccagcccttcgggaggccgaggcaggtggatcacctgaggtcaggggttcgagaccagcctggccaagatggtgaaaccccatctctactaaaaatacaaatattagctgggcgtggtggcgctcacctgtagtcccagctactcgggagcctgaggcaggagaattgcttgagcccaggaggcagaggttgcagtgagccaagatcatgccactgcactccagcctgggcgacagggtgagacttcgtctcaaaaaaaaaaaattccattttaagtaatattaatacaactttgcataatcctagataaaatctgtccaggaaaggtttttcccatcaagtgcacagcataaaaacgtggagctgccctagtccatgcggaaaagaatgaactgatgagggaatattccttcattctccatcttatatgacttgctcttggcaactgctatgtttaaattaggcttcatctccaaagctttcatggaaaagactgactattatccctagtaaaaatgtttatctaagaaaactcatgttcatttctaaataagttgaggggatctatcacaaagcccctttaaaaatacaaacacgatgcatggtttgtagctgatgtggaggcttcagtctaaacctgggagtgtaacatggtgaaggaaatgagaaccagtctgatctcttgactttcctgtgcacaaggcttgatgccatttcattctccaagatctctaaaggtgcctgagcagaaatccacaaagaatccttttcaagccttctgttttccacttagcatcagacaggtcaactgtttctttcaggaattgttcgatttatgccatagtctgcccaatatttaaaaaacaatttctcttttacatagtaaaagtgcaatactataggtgattaagtgattggacacccctgcctcctaccataggctgaagatgatgtgggaagaaatgagaatgccacagaattaggggggaaggagggtccaaaagtaaattttacagcagtgcccttttccctgggtggctttgtcacaatgtcactcaggggctccttggtgcccgagtcccaggaggtgtcccctgcccccatgtgttttcattgctctctttcactgcccctttgttactcagtgtcagtttccttttgctttcgagctgcaacagcacattcacacatccttcacctgtcaccaggtgatgaggctgtttcctctgtgcattcttgacgctgaacctcggcctgatgagctggagtaggaggattcaatcctcagggcctggatggttgctgtatgatgctgagtaaattacttaacctctctgggtctcagctgcctcaccttttaaataagaattttgggctgggcatggtggcttacacctataatcccagcactttgggaggctgaggtgggtggatcgcttgagcccaggagtttgaggccagcctgggcaacatgggaaaccctgtctctacaaaaactacaaaaataattagctggatgtgatgacacacacctgaagttcgagctacttggggagcagaggtgagaggatcacttgaaccccgtaggtcaagactgcagtgagccttgatcatgccactgcactccagcctgggtgacaaagagacacctgtctcaaaaaaaaaaatgaattttggaccagatgatttataacactggatgagtgtaaatgcagtttaagcagaatgttctggtgttgttacctcatctccagaaaagtgttatttccatcaggccaaatgagcaatgtagtgagagaagattcactgaagtaagactcaacaataaaactgagtaactcccaagcttgctgctaacagcagggctggagcccaaagtacagttgatgaaagtcaccactaagggtgggttccccgtgagttatcttggggacttggggcacagtggggcacagatgtgcctctggctggggtgcctggacctgtcttagggcaatgtatgtcaaggatttacatcgagaacgtggtgtctgtttaagatgggttctcatgtctgtaggaaatagggggtgtcttttcttattgcaaatcctcaaactggatgaaaaccttcacactagattttaaatccacagacatcccagttctgtagttttgatgcttctctgtgcttccatttccttatttctaagatgggtttgtaattatctgcttcatggcattattagaacaatcaaaattctgtaaagtgtcaattgcagcatctgagaaggcaagtgcttaatacatgatggccatcgagctatccccctatctcaggagaaagggtgtgcctgcagcatgcaggatgcagagggtgtgcccccaggcaggggagacccaggtccagcatataccttgctggctcaggtgccctgagggccgcagctctgttcacgttctccattatgaactcccataggacaccctgttttttccactcacttaagtacttaattaaatacttttttcaagctttttttaacttattcatgtgtgtgagttccgtaggataccatggtcctgccctcatggaatcacggtgctttaagtcgtcaggacattttatagctcatacacagtagccagatccctggatagacacctgaatgacaggagagtggagcccatgtcaggctgctcggggcttcctgtgagggagcatcgctccaggcagagaaatatgggcaggatttcaaagtgtggagaaaaggggaaaatattcctggtgcctggaacagcataaacaacaagacattatggggaactcactgggtacctggagggaaccgctgtgggttgcagttctgaatctgtggttggactccttggtgagaccacaagagagacgtggaaagaattaagagcccagggtctagtgactttcctgccatcttgaattcacatcgcctcatcttgagtcaagaagatgtttttctgatgctgggtggaaaaaacaatggatttgggagtcaggaggcaaccgtgctcctggcactaattagcaagacaaactcactgtctgtttctccttctctcaagtggggataaagcctgcccttcaccctgtacagagtgatcctgaggacagaataagatcagagatgaaaggagcactttgcagaaaagtccaagtgcccacatgcgagagaatattacatattacaatatcctcttctctttgctgtggaatccaggccttttcccaaagtaagaatcgtggatgctcactctcatgaggggtttaggcttaattggaaatcataccatgacattgccttctggaaaattccctggagaatcagccaaagtagcagcaattatccggggaggcagcttggcaagaactgaaccgcgggggttggtgagatttccctaagacatcctgtcacacagacagagtgttactctttcattttgcttttcccactgggaagacctaatttttctctctattgcagcttaaagttttaaagcaaatttgtttgagtttataagccagaaaaatggaagtataacatcaaatcaggacccaggaagccaacccagctgttgattggtcttcagttcaagatggagtcatagctgaggtgacaaattccaggaagatgagtggttggggtcctcactccctgccaacccagaaacacttctgacattgaatgtcacttccttttctgacagcatcactgaaagaaaatgagaaccctgagctagtagctaataaataatagatttgtaaaatagctatatatttatttcaaatgttttgcctttgtctaaagggacctaggagaagataatcttgtgtttttatgcatatgattttgttttaatctaggattttctattcctctgactcatcagaacttattttatcctacatttcttactttgtgacctgtagatatttgtgctagattccttcattctttttccttctgctgtaaggaaacttgtcaatgtggggagctcttttgagaaatcactcctatttaataattgtgtgctatatctgtgtcttctgtccccttttgtaatgaaaataactgccctctgctgccatagatattagccacccagacagcttcaccctcccggcaactcaccttttgccttgatgccaatgaggtcctctctgcccttgtgtctctttggcctgagacaaaagagtaaagtccacaggtaggtaactcccagaaggatctctactgcctaatctctcaggcaacttttttatccccgcctttaaatattttttgttcattttaaaatgatgtatgtatgttgatgggcaacgatttagcaatgctcttaagaaaatggtgcattttccttggataatttttacttgtgatactgaaaagttagcttgattattttaaccacttttttgagagatcactgacataaaaattgtgtatggttatagcgtacaacttaaagtgttgctatctgtatacattatgaaaagactgccaatatcaagttaatttacatatctatcatctctacatagttaacatttgtgtatgtggtggtgtgtgtgtgtacagtgtgtgtgtaatgagaagatttaatttaagatctatgctttatttttttaatcatcctaacaaatttcaagcatatgacagggttccatcaactgttgtcactaaactgtacatgagatcaacagaatgcattcatcttgcatcgctgaaacttagtagcttgatttaaagaagaagaaaaatattgagtgcctggcaaaatctaaaaagcgcctcctgtgtaccaagagccggggcagacactgaacaagactcattcctgctgccgtcactgctgagctcgggggctgctgctctgtttggagctcctgctctgtgtggagccccgtgcggttctttttgtcatctcacctgcaggctcttccctgcactgccaccagctcgatcttgttttctcttcccctttgcgcttttccacagagctctgattcggacctgagtgtactcctctgtgtgcacgtgccgggccctgcgacacacgcctgtgcttctcgcggggtcagtcatggctttggcctccctggcactgctgtggtttgctgagattttagtgatttctgccgattgcctaaactcagccttggacttcattccgaccccatgcaaggctgtgtggataagccgctgtgaaaccgcctggtacaacgtgatgacgagcagagatacattttgcatccccgactcattatttcgctgtcaaaatgttccatttcctctcctcctccctcgattatagttctctgtgagtggtgactgcatggttaatcaccggctcatcaccggtctgtcacaaatcctggcctctgtacttcatgatgcattttgccaagttccttcagggccagatatggcttatttatcagactgcagggatttatgaacattttcagactttggtcagacacctgcccccaagatggggagaaaagaagcaaaacagaagctggaaaagaggcagcagttcttacaccccgaaaggtgcatgtgaacccatcaaggggcaacccaggccctggccagagtgtatcttatctttcagcagaaggaccaggtgggaagtgaatatctgtggaaataagaaaggccaccaggcagatgataagtccaacgaagaacggtttcttgaagacctgctatgtgggtttgtcaatcaatgcatccgagcttttcctcatcctcaagctggttccgcctagaaaataaggctggctgatgtctgcaagattttgtttctttctgaacatttttcaaatttgtattttttcccctttaacaatccaggtattagtagtattaagacatcctacatgctgtgtggcacaccatcaggccaggcgcggtggctcatgcctgtaatcccagcactttgggaggctgaggcgggtggatcactagatcaggaattcgaaaccagtctggccaaaatagtgaagccctatctatactaaaaatagaaaaaaattagcctggtgtggtggtgtgcacctgtaatccctgctactcaggaggctgaggcaggagaatggcgtgaacccaggaggcagaggttgcagtaagtcaagatcacgccattccactccagcccggggactgtgtgagactccatctcaaaaaacaaacaaacaaaaaaacgtcatagtatgtgttttataaatatgtgttgaccaaattggccccattatttagacatggaaactaaatcgtggaaaacttccaccacagggcactttgatgtaaatattcggtgctttgggtcttcagccggttaatgttagtagcagaacgtcctatgtcttcatttgctttggcagtaatagggatgaaatgtcctttcccttcttcctttatgtcccaagccctatctaagcattaaatgaggttaatatatattaatctaatatacggtaggcacattgatgtgtatttaatgtgagtcatgaataaaaaatattttgtccccttcagagatagattaattttaattgattcctccagtggggaagcagcctcttccttcaccagagaagtgatagaaaggaattctgagatccctgatggagtgtaggtgggtgtatccatcaggggtctccagggacagagaagcaagaggatgcacatagatatatatgagacatttattccggaaatttgctcacatcactgtgaaggtcgcgaagccccaggatgtactgtctgtaaactggagatctgaggagctggcggtgtaattcaggtgactctgaaggcctaagaaaccggggaactgatagtgtaatcctcagctgaagtggggaaagtcactggtgtctgtcctggagttcaaaggcctgaaaaccatgagctgtgatgtctggggacaaggaaagatgaatgtcccagctcaaggagaatgagagagctttctcccttattccacctttttgttctgtttgggccctcaatggatcggatggtgcccacctacattggtgagggcagatcttcttcattcagtccattgattcaaatgccaacctcttctggaaacaccctcacagacacccaggaataacattttaccagctatctgggcatcccttagcccactcaagttgacacataaagttaatcatggcagtgggatgttttggcatgacagtaggctggggtgctccttatagcacttctttaagatccaccatagatggtatttgaaatggaagcactttatcagatgtgccctgggttatcccagagaagtgtgaaggtgctgggagaaacacaccatctcttgtcactagccttggccatggcccctcatcctaagcaagaaaaagcaatgcttgttcagagagatttagcacagactctgagggaatcagaggtcatgctggctaagaagggtgttatgtctttagaaaaagggagtgcatttccttgcccttatgaatctacaaagagagaaggtttaaaattttctttgcccaaatgagccttttggacgtgtatagcatgtggcagtcctctccagcatgactctatccatagctgctgacaacactcctagtttttcatgactcttaacctaaaggaggagtggcaggtgtttcacccacaatggttcaaggtcttgataatggctcaagtatcatgggttgagagttgaccaaaaagaccctttcctgggagactgtcttctctcccccaagctgtcctcatatccaggaacttagctgaagatgctgtagagctagggtggtgggtaagccctcgggctttttgctgccgtgagttactcttaaagattctttatttttcttgttctcttaatgtcctaagccaacctacacactctgatgtggcatggtaaagttgtgacttctatgcctccatgcaaaatcttcacctccagggctgaggcttgggcatgtgccttctgagagttccattatgttcaagatcaccatcaaatatatcttggagatcaactgaaccaggcctccttgactttctccagagatcagagcactgattctctaggggagaaggcacttccagatattctacaaaggctttaaaaaaatggaatctagatgagctctactacatgtcctcctccaactaaactttaccatgttaatcaactttcagataaaatgatacacaaaataaatacatagacaaaattaagtttgaatatattttcaagatcaaaataagtggcccaaattaatcattattctcatatttcacagtagaatataatatgagtatcaaaaacagagttgtttagtccagaacatgtaccagaatccaaaggcaatttttaaaattttatgtccatggtcctttccactttattatgattgtccctgaaattagactcattcttagaaacattactgtttatggtgaccaagatgaatgtcaacctgcccctcagcttgtccaagcttgaaacattcttcttcctgactcttggtcctgacctccctttttacagcattttctttagaaaactagtaattataaattatttctctgtccttttgagatgtaaaccattttaaaggcctcttgctagttttataacccaggagctttgttctcaagggcttgggagccatttctttgactgtaatccttaaagaagtcagaacctctatctcccagtccctgtaggaggggagaagcctaactttggtgggcaccttgctcccaattgtgaaattacttcctgctatgaagatacaaaaaagtttacttttcctctggataaagccaattaacaagcacagatggcctctcatcttctcccccatcccagctcttaaaaactctcctgccctttgcttcagcagagttgagttcaaacgcagttctggtctttctcaccaattgcaatagccttgactaaagccttccttgtctgtttaggtttgtctagtgcaatttttgctttgacagtggtgaagtgaaaagaaaaatctaaatggtagttagtatctaaagataaaaaaaaaggatgtcagaaaggagatgaagcaacaaggaaactggaggcctagataacaatgcccatagttcttcccagtattcacactcgactggaatattgcaaggcttgtctttaaggttttgcaagatcctggtactctatattttccaagacaaatattcaaggtggccttgggatttgggggcttttgagcacaatgcctaatacttttttcagggtggcttcttataaactgcaatgttgtatcagtttctgagtcattttaaatattttaacaaatgtcacaatttattgtatctgtgtcttgcagctgcctaaaccaagatacacattctaaggctaagaaactacatcacaaataaaattctaagtaagagtgaaagcaagatagctggaaatgtagggaatcctgctagagctggagagaggagagtctgagataaccatgtgtatttaccatgaccaggtttatgctgggcttggaaatgttaagatattcatgttatcagtagcccacaagactggatggacattccttggggcccatctgcagtgagttaggcctctctaagtcttgtcaggggcccacaagaggcttccacttactgaattagaaagggctatggctttaaccataaagggctttcctttttgccagcttgtctgggccacaggttctagaccgtggcttcaagctcaactggtccattgacctattatttattccacacacactctagcttacttccccgatttttatttaccattgcttgtctcccattctagcaagtcactcaagcaccaaacttgggtgtcatccaacacctctagccagtcagtgaaaaagtcctatatttgcaacaatgtggatggaactggaggacattatgttaagtgaaataagctaggcatagaaggacacatttctcatgttcccgctcgtaggtggaagctaaaaattaaacaacttcaactcaaggagatggtagaatgacggttaccaggttctggcaagggtggtggagaacaaggattacagaggggatggtcaatgagtacaaaaatacagttaaatagaacaaataagatttagtgtttagtagcacaaaagggtggctatagttagcaataatttattatggatttaaaactaactggaagagtagaattggaatgttcctcaagcaaagaaatgataaacacttgtggtgacgaatacccccattaccctgatttgatccttactcactgtatgcctgtatcaaaacaccatatgtacccatatgtacaccatatgtacttagtgacttaaatatttacaactattatgtgcttctagtaatttctttttaaaagttgtgtagatttcagctatgatttttttctaaactatcacttcttctctatcattcctactaaatggtctacttcagatccttgtcatctctggccaagactactgtaattgcctcccattaggtcacttatcttttatttcacagcatgtttttccccacccagccagaagaataatttttcaaatgcaaggccaaccatatcactccccaactataccatccagtgaattcccattgagcacacggtaacatccaagcatcttaaccaggcacaagtgactctttataacttgtcccctctctcatccctctagtgctatccatatctcagtcctaacaatattggtcaatatgagataaatcctaacaatatagaccgtgtgtctgttcctggacacatcatgctgtttcaggttaccaggccttcactcatgccttgtcatcattcccagcctcacaaactactactttacaattgtgaattgcttatagttcctggtaattttaagtctctgtttgggcagtgactcctggactggtgacaagtgatcatcttggatggacaatttcctcttctccatccccagagccgggcttgcccagggttcggaccactcttcagcaatacagcaaggagtaagcttctgtctggtatcatcccacctctctgttccctttcctacctcccatgcaacctgttatctgtggtgctgaggtcttcgtggtacaaatctaagctggcctctcctggacaaggacccttgtttttttcacctataacttcctcctcttacttttcccttagtaaaactcctatgctttttttctggacagtagcaggaaagaaaaccactgactctattctttgtgctttgatactaacaatgaatacactccatgtgttaaacacctcagaggattatatatatattttaaggagagaataattatttaaaaattgctcaaaagagagagtttgagggaagacgagactattatccaggaacccagaaaagtacttttaagtaatatgctagttaaacataggtgcataaaaaattactccagtacgtagtgacttaaaacaacctttattatcctattgtttttatgggtcaggaattagggagaaaattgttggagtggttttgactcagggtctctcatgacatcgtaatcaggatgctggctgcagtcatctaaaggcccacctgggctggaagagctccctctgagttggctcactcacgtggttgtgggtggagtcctgtttcttgcagccttcccttccttgtcacctggatctctaccttgagctgtctcagtgttttcatcacatgactgtagctacccccagaatgagtggcccaaagagcaagaagaatctgcaatgccttttctgacaatgtcacacattgtcacttctgccacgttccgtcaccagaagagagtcaccaagtccaggcttcattcaagtggaagagagtaagtctccagctttggagaaggggattgtcaaggaatttctggacgtattttaaaatgatgaaattatctgtacaacaaacccccatgacatgagtttgcctacataacaaacctacacatgtacccctgaacctaaaataaaagtttaaaaaatgaaaagaaaaatgatcttattcttcctttgcataagacaagagtggcagtctatgggcaaaggatgcttcaggacttctttctatcaagccccttcctcctgttcatagtttgacacagaaattcaagctcccagaagcatgatccccaagagaatccatgatcgtttacttttgtgtacttttaatcgccctttgtaaggaacaaactatttctcctacacaatgctcacttatgcatgaatatgtgaattgtcagcagtggtttctgattgcacttgttatctaaccaggagtacaggactgaaattttgctccaaatagtgtaattctacttgcatttaatcattgacagttgtgatggttaatactgagtgtcaacttgattggaaggaaagatgcaaagtattgcttccgggtgtgtctgtgagggtgttgccaaaggagattaacatttgagtcagtgggctgggaaaggcagacccacccttaatctggtgaccacaatctaatcagctgccagtgcagctagaatataaaacaggcagaaaaacgtgaaaagattaaattggcttagcttcccagcctacatctttctcctgtgctggatgcatcctgccctcgaacatcagacttcaagttcttcagttttgggacttggactggctctcctttctcctcagcttgcagacagcctattgtgggaccttatgatcatgtgagttaatacttaataaactcccctttatatatatctatcctattagttctgtccctctagagactaatataacagcttttactctatgaaaatgtttagtgcttattagtagagaacaaggttcataaatgctagtgtgcaaaagaattttatggagcacttgttagaatggagatgtctgggacctaaccctagttattttcacttaattgaagtagagtaggcccattaatctgaatattaataagcagcaggtaattctaatactggtgatcacagactgcacttagagaaacactaattgtagtgagtgctactggtgccccaccctgatccctttagcaaggcggtgcacccatacaaagttgctggcaatatcaaccatcacagtctcctaggtttccctttatgcagataattctcctggataaacaaggtttacctggcccaggaggctgcatcccccatacctagcagcatggggtcaatgactacgacttaatcagagatgccaaagactggacttctagactgtgcaggaaattaactcttttccaactcatatgtcagggctctgtggttgaccaagctgaagcgagtttccagctaagaccacatgtgactgcttagctactttacccagccctattacacttttcttactccccttttcccgagggtttcctcagtgaatcacatggagaaaaatccttgtctccagccctgcttctaggaaactctatagattaaccacactgggcttctaccctgagattcaataggttactactggaacaaaacaagaaggcaatgattatatgtattgtaggaggcgcagtcgggtttgtaagaacaaattcagtatttccacattagagtccacaacataaagatgtagaactccatgtgaaaacacctcaaaatttacaaacagtcagaattatcagatgttggatctccgtaattttcagggtaattgaaagtggcagcaaaaatgtttttatttaatgtaatgatgccattgccttttctggatagtatcctatgatctgcccttcctctgaataaggcattttgtaaaaactgatgaaaatccaagagattagcctgtaggtctccatttataattatagtgactcttgccttaaagtcttttgttattttcccccttatttctttaggatacattagtcattgccttagtctagcttatggttaaacagatttctatttttgttccttgatacagttaacctaacttgaattttcagaattgatcaaaatactacatcacccctgatgctaactctctaatgggatttgaataatgtactgctatataccatctggaaattgattgaatctcaaatactaggacgttgaattcaagaatgtacttttatccttttgtctcttctgagatgctaggtaatattctataaaataaatgtcattcctattttttaaaaaaaaccagaagcaagaagaaaaatagttcattttatgagttgtataaataaatcttttttaaatatagaattttcaaactcaaactaaaagacaagtattaaactatatctaaaattatctgatttaatcctcactgattggggcctttaagaacaatttgccataatatgaaacgaggcagtatacatttgctgattctaaaagcaatgaacacttatgatggataattctttacatacgtaaagtacataagagaaaattaaaaagtaaatatagcctacaatcatttcttctgaaagcaaccactcttaatatgtggtttattttcttatgatcattttttctatgaagcattttaaaacataattataatttaaaagtgcctagagttctacattaattctttatatattatcatataatcatttttaaaggtgttgtttcctttcctccaacatttatatctttaagaatttttttctaattcaaaaatcatatattgggtgacatcacagaaaatggcagagtagggcacttgaagaattggcccctcactgaaacaatgataagctgacaaaaactgatggaatttactgtctcagaactccagaatctaatccagagcttacagcaacgagcggactcctaacaaagagacagggagctgaatttgggcaagagagatttgcagtgttttggctcacctgcctactaccatgcttccccccattcctcagagtggaggcaacagctgtggggatggaggccgacgttcctggtgtggctttttggtgccagggggctaataaaaccatgttctttaaatactctggttttgtgttttgtccagtatggcagtgctctgccagaattgatgcagcgactaaccctcgttttgctctccctaacttgggcaggaacagctttccaggcagtggggcctctgtcaaaagatttaaagacatgcattgctcatttctgcctgggtcaagggatgacagatgagaccaaaatcacagggaagagaaggctgaagggaaaaatttcttgggagaataaagactcagaagggccaccacctttaccagagaagatgaagggcaaagctcagaaccagccacatgtgctcagaaccagatgcatgctcaggaaagacctgagctaaccctagacttgcattctggcagatctgtgggctccaggcaggcaggtggtgaaggataaaacagagccataagtggcctggcttcatattaaagaagaatcttaagtcagggccaagatacatagtcttgtagagtagtatctttctcgtttttgtttttgctttttggctaaaggtgtttaaggaaatatttgtcagatcattggctgtccactgaaataatggagcaaagacttcagtgactacatgtgaacaaggaatacaaggtttgcaaaaatagtttgaaaaagcccctaaataagtggacgactgcagcccttaacagttaagtacagcaaaccctggggaaggtgggggatatctgacttctatagtttccagattataatattcaaaatgctcagttttcaacaaagttacaaggcatacaaaccaacagtaaagtatggcacactcagaattatactagaagtcctagtcagagcaattaggcaagaaaacattaaaagatattcaaatgaaagagagacaagtaaaattatctctagtcacaattgcatagttcctacatatagaaaatctcaaggaattcaggaaaaaaactaccagtgctaaaaaaaaaaacaaaaaactatcagtgctaataaattcagcaaagttgtgagatataagatcagtacacaaaactcagttatgtttctgtataccagcaatgaacaatctgaaaagaaattaagaagacaattctccttacaatggcattaaaaaataaaatatctaagagtaaatttaaacaatgagatgaaaaagctgtacactgaaaaccacaaaaaattacttaaggaaattaaagacccaagtaaatcaaaagccattctgtgttcgtggattataacacataacatgcttaatgtggaaaactaatgcaagtgatctacagattcaatgtaatctctttcaaaatattaatttttttgcagaaatggaataattgatccctctatttatatttttaaatcattactcattgtttaattcacaaggggcctgaaacagccaaaacagtattgaaaaagaagaaacataaacttatggttagactggaaaagtaagttttagtgatatataacactacatggcaaccacaattgatgataatatactgcatttcttaaaattgctaaaaggatagattttttatattctcatcacaaaaaaataagttggtggggtgatagatatgttaattaccttgttgaatctttctacaatgtataaatatattaaaacatcacattgtattccactaatacacacaattattagttgttgattaaaagtaaataaagaaaaaggagaacaatgttgaaggactatagtaatcaaaacagtgtgatactggcataaacatagacatgtaaatcaatggcatacaatcaagagtccagaaataaacccatgcatctatggccaaccgattttcaacaagggcaccaagatcattcagtagaagaaataacagttttttcaacaaatactgctgtgatagctggatattcacatgtaccaaaagcattaacaacaaaagaaacatagataaattggacttcatcaaaattaaaaacacatgtgcatcaaaaaatattatcaagaaagtggagaaattacctagagaatgggagaaaattctgtaatttctcctcttacaaagtttcacatctatatattggacgaagatctagtatctagaatatacataaagtacacttacaacacaataacaaacaaacaaaaaccaataaaaaatgggcaaaggacttaatgagacatttctctaaagaaaatatactagtggccagtaggcacatgacaagatggtcaacatgattagtcattagggaaatgcaaatcaaaaccacgagttataacttcacacccacttgaatggacatgatttttaaaatgtaagataaaagctggcaaggatgtagagaaattggaaaccctggaaattcctggtaagaatataaaatgagtcggtagatgtggaaaacagtttgcctgttcctaataacgttaaatatagcataaccatacgacacagcaattccactctagatatatacccaaaagaattaaaaacagatactcaaacaaatacatttacatgccttttcatagcagcaaatagccaaaaggtgcaaacatctgaaatgtccatcaatggatgaagatgaatgaataaacaaatatataatatatatattagaatatttatctgtataaaggaacaaagtattgatacatgctacaatgtggaagaacctcaaaaacactgtaggtaaaagaagcctaacacaaggggtcgcaaattgtatgatttcacttatatgaaatatccaggtaaatagataaatccatagaggcagacggtagtctatttatttctaagagctgggtgagagaattaggagtggctgctgaatggacacagagtttcctttgggggtgatgaaagtgcttggtactctacaaaggtggtagttgcacaatatcgtgaacgtactaaatgtcactgatttttttttttgctttgaaatggttaattttgtgttatgtgagtttcacttaaaagaggaaagcggccaagtgcagtggctcatgcctgtaatcccagcactttgagaggctggggtgggtggatcatctgtggtcaggagttcgagcccagcctgaccaacatggcaaaaccctgtctctactaaaaatacaaaaattagccaggtgtagtggtgggcacctgtaatctcagctactcaggaggctgaggcatgagaattgcttgaacctgggaggcagatgttgcagtgagccgagattgcaccactgcactgcagcttgggcgatagaatgagactcagtctcaaaaaaaaaaaaaaaaaaaagaggaaagcaaaaaatatattttttcacatatattgatggtttgttctttttttattgttgagtagtattctgctgtacagatgtatggatgtttgtaattacagtgatagagaacagatcaatggacacaagaggttagaggtgggagaaagacgtgattataatgaggtagcctggaggttttttttgtggtaatggtttttgtagttctcgttagttgtgatagttacatcaatatgcattatacacgtgataaaatatcacagaactaattaacaacaaatgaatacacatgaaaactagttatttagctaatactcagtacctactagttccaatttcctgattttgacaattctgactgcatggtcatctggcgtcccatgtccaaatgtccatctctacccagatgcagcagcactccatgagctgttccatgaaatatatacatttttctgttagagttcttaaggctttaatctagaacctcagggcctgatgtaattctcctattgatgttcccataaactctacacaaaatcgtctcccaccatagacacctctaatgatacagagtcttatggcttctatgacctgagtggtaaggaggctcatatcataccccagggctgctgacgtcctagccttagtgtcatgtggggtattggtcagaacggagttctcgagtgtggaaaatgctgtcttcaggacctgcagcatggtgctgccatcttaatggtgagaattgtgacctgtattcacttatccttaattcagagaaagtgccacagtatgtcaaagactcctaaacatttcagccatatggtcagccctttaatctgtgttatctttgaacttcggaactgcccatgttctaccaatgtacttgctacttctgtcccaggtgacatgaattcatcaacttggggacacatgcgatgttctgtgtaatatccagatattccaggtctctttaagcaagtgagttaatagggatctagagatgggctgcgaatttacactgttgtgtgttccaagtaattgagaattatttctcattttcctttttcaataggaatggaacagaatgcatttcccatatcagtgatcgcccactctgtgtctgaggctacgttaatctgctttagtaaagatgccacaactggcgtagaaactgctattggagctactatttatacgagctggaaacaggcccagattggtgaattaaatggatatatgagggagaacatcagcactgcattccttctgtttttaagggtagaactaaattctaccattcctcttgagagccatcttcactatgacagctctcatcccacaggaagaacaacaaaggggttctgccagctatgatgtgtatcctaattgcacactcagggaccaagcgaacaaccattgattgcatccatggacccagtgaagatgctgtgtaccagtctggcctcagaactccatttattgtctatatccctatacatgccaccatctatttgttaatggggagggttgtgatgacactttataaacctggggctccttgtccaacagctctcaaaacatgtaggtattccctttcctcagggtatgttacctacaaaaatggccacagccccctttgggaaagggctgggtgaatcattgttatacacaatgtttatggtgttgtgagatccttctacccaggtacctgacctcctcttcagtcaatgggctgtaggtatgaaaagtactcaggtctagaaagtgggccatggatcatgattttttattagagtgacttccctcatgctctgatcatttattcttgatttcaccattaataaaccctccttggctattcacctatcttgcccttacagcttctgtattctattagccacatccacagctcttttgatatcagaaacctgattgccactctgacctttctattcattaaataattgtctccactttgctgctgatggttaagcattatcaaattgtttctattatttggattacaaggatcatatcatctccattaatgataattctcccaaagcatcttctaccctcaggtctggcttacagaggatgaccacatctgagcttctggtgctggtgtccttcttatcattctatgccgtatcagttggccttgtgtggtcatttatgcattctaaaatagcttctctgagtctttgatctcttcttccatctgatgtggaagttctggcattgatactcagtggaggcgattacctctctaagggtctaagagctgtcttaccagcatgtaagcatccactctttagccacaaagatgctaaatcgctggtcacagctaaatgctcccatataaataaactctcattgtctaactccatattccagatcccttggcccagcaccctcgggttcctgttttataatactttcacagtgctttgcaatccctactgactaattgctaccgctcgttcaggggactgtcccttagaatacccagaacttttccagccaggtttggttttgccccatcccttgtttttggtctagtggccaggatggggagtgcacgtaagccaggaatagaggtggaggtaacaggcagagcatgggtcattttgcaaggcaaatcctctgcagcaccttaagcaagtcaagaacaccagccttaactagaagggtttggctccttctacagacccagaggctttagggtcacgatttcctactgtgtacttccagactcccctatccccagtctcagggtcctactcttctcaatcacagctttgatcttggccgagcattgctgctgcgattaagaattcattcttctctgctgggcgcgttggttcacacctgtaatcccagcactttgggaggccgaggcaggcggatcacctgaggtcaggagtttgagaccagcctggccaacatggccaaaccccgtctctactaaaagtacaaaagaattagccaggcatggtggtgcatgcctgtaatcccagctactcaggaggctgaggcaggagaatcgcttgaacccgggaggtggaggttgcagtgacccgagattgcaccactgcactccagcctgggtgacaagagcgagactccgtatcaagaaagaaaaaaagaagagagaatttattcttctctaaagctctgcttatcttagaaataatttctgggcctgatatacagattttttttttttaattttttatcttctgccctttggctgtagaagacaagaacctttttatatacatgccaaagaagtcctttgcttttcatattgtgcctttaattgatgatgaataacctcagccttttattgtttttctcttaggtgtcaatcatctaatttcatgacccttatggttattattttctccattacctctccaacaactgaaaaatggcatattacaccagccagtgcatttcctcctttgccatttcaccccatttcaccactgatggaagtttttgcaattgtgttgctactgcagaagaaggactccctggtctctacctatcagcaatgatgaggtgcttgttggcagcccactgacaggtgacccagctccaaaattccattttagaatctgtttcatcagaccaatcctggcattaaatgtcacatggtaactatatttgcgaaacagactgtaagagggcgatgtttatacaggtaatcttgggggttatacccttgagataaacacccatgagggagtgacggaggtagggctggtacaggaagaagttgaactatattcctgttacaaaacagcctcagcagattctctggagagctctggagcagagattgctctctggaattgtccagaagtaaggatagatatccaatgacaggtgtcattggatgtggactgtccccagatctgtccccttagagagagattcaactaagagctatcagcaaccacatttccagatctggataaattacttcttctgtcctaaaggggatgggtggaacctgggccttgtgctacagaatacaacatggaatttcagggaaaggtcatcaaaaaggttcaatgagttctaaccaggtagtctttattctaagggctgattaattcccaatttggggagcactccagcctccagcttaatcattgtgattcagacatagtagatcagactgcagaataaaaatgttaaaggaaattatttagatggaaggaaactgatcctagacgggaaggtgggttgataaagaaatgaagagcaccagatacagccatatgctagtaagtgtaaaaaatgtaaaagcccttttcttatcgtaaaaagtttttaaatgataactgtgtttaaaggacaatgataataatgttctgtgtgatttatcctgaagtaaaatgcatacaaagacagcacaaaagataagtggtaaaaatttaaagcatactgttatatggtatttacattaaatgtcaaatggtatattagtatctgaaggtagactttggtaactaaaaggtgcatattataaactgtagaacaattgctaaaaaagaggtatagttaataggcctacagtggtaataaaatagacttataaaatatacttaatccaaaattagacaagaaaaagagaaatatatggacagtgagcaaatagaaggtggtagatttaaatccaacattatttgcattgcagttagatggcctaaacactctatttaaaaggcagaggcagagaacttagattcataaagaagtaaaaccaattatgtatcatctacaaggcacagtatataagtatatagagataagacagaagcgaaaatgagaaaagatgggcaaaatactatgcaaagagtaattataagaaggctgaagtgttactaattatatcacacaaagtaaacctcagaacaaaggacattattgtgggtaaagaagaacacagcctaatgatataggggtaaacccattaagaggatatagccatcctaaaggtatatgcatataacagagcttcaaagtacacaaagcaaaggctgaatgccctgaaaacagaaataacatatctacagctgtacttgggaatgctaacacttgtttcttagccattggtagaacaagtagagaggaaatcagtaagaatatagaacacatgagctgcactaccttccaatctgatttagttgatatttatggtacactctgcctaacaatgacaaaatacatgtaattccaaaggtacatgaagtattcaaaatagaccctattccaggacataaaatgtacttcaataatgtgtaaatgaatcaaatcatataaaaacatattatctgaatcaaatggagttaaaatagaataacaagagtatatttggcaaatccatctattatctggaaattaaacaagatacttctaaatagcctctaggagaaaaaaatgcacaagataacgcagagaatagtttgcattaaatgaaaaatacaacatacagaaattacagggatgcaggtaacacaatgtgtagaaggaaatgtgtaacttataaatagaaaaatctaaaaataaatgattgaatatttcaactgtggaaggcaaaaaataaagacaataaacttaagcaaaagtaagtagaattaagaagataatgaatgatgcctggacagttgaagacgatggccacactccaggaccccttcccccagtttttctctggaaaatgtggagaacaacaagaaaggaaaagtaaacaaaaccacaccctcagaataatttgaagacagaaaataaccaaaattcaatataaggataaataagggtgggacaccaaatttcagtattcaacctctcatatcctcctctgatctgccccctgaccctgcctcaaggctttttttagaaacaaaaaataccaataaaaaaaggcagggaagaggaaagaaaggggatattcctggatctaagtttgatctaaaatcattaccagaaacacttaatctattcttaatctaaaaatactaaaaagtgtttgaattacccacaaggtatttaaatgtatgtgtgaattgaaggggcagtcctcaaaatgcatagcttcggggagagacatgacatttggtaatttggtggagaaagggaagagaggaaagcggaaaatttgaaggtcctattaagacaaaagaaaagcacaaaatcaaaggaaacacaatctttttcaccccctacatactcatgctaaaataaaatttactgaaggatctgaactttgctctattaaagaaatgggcaatgtttagtccctccaatcctttaactatgaaaaatcaaagtttaacagaataattctaagaaaacgctaagattaaattcagcatttatcatttgaggaaaatccccacactcttgataaatagtcatgaaacaaaataaaactataaattagctctccaagtgaaattaaatgtatttaggcaagtatttaggatatgaaaaagagcttttaataagaaattcaattcagtagcatttctaaacactaacaacaaactactgaaaattgaaattaagaaaatgatctcatttacaatagtgtcaaaaggagtaaattattcaaaaataaatttaaccaaggagttgaaagacttgtacgctgaaaactgtaaaacattaatgaaagaaattgaagacacaaataaatgaaaagctaccctatgttcatggattggaaaaattaatgttgtgagaatgtccatactacctgatatgatttggatatttgtctcctccaaatctcatgttgaaacgtgaccctcagtgttggaagtgaggcctatttgggaggtgtttgggtcaggggggctgatccctcctgaatggcttggtgatcatgaattcatgtgagatctggttgtttaaaagagcctggccctccttctctctctcttgccccctctcttgccatgtgacatgcctgctctcctttcactttctgccatgattggaagtttcctgaggccctcaccagaagcagatgctggcagtatgcttcttacacagcctgcagaattgtgagccaaaataaatttctttcctttatatgctacccagcctcagttattcctttatagcaatgcaaaattgactaacatgctacataaagtcatctacagattcattgtactttctatcaaaatcccaatgtcatttttcacagaaatagaagaaacaattctaaaattcacatggaatcacaaaagaccctgaatatctgaagcagttttgagcaaaaagagcatagctggaggcgtcacacaacctgacttcaaaatatactacaaagcgatggtaattaaaacagcatgtcactgcattaaaaaaaaaaacacataaaaacagacaaataggccaataaaatagaatagagagcccagaaataaatcaaacatttatggtcaattgatttttgacaaagatcctaagaatacacaatttggaaaagacaatttcttcataaatggtgctaagaaaactggatattcacatgccaaagaataaaattggaccattatcccacatcacatacaaaaatcaactcaaaatggaataaagactcaaatgtaggacctgaatctgtaaagctacaagaagaaaacatagaggaaaagctccatggcattggactgagcaacaatttttttatatgaccccaaaggcaaaggcaacaaaagctaaaatagacaaatgggattgcatcttactaaaaagcttctgaatagcgaaggaaataaacagcagcatgaaaagacaacctatggattgggaaaatgtatttgcaaaccatacatctcataagttagtatacaaaatatataaggaactcaaacatctgaatagcaagaacacaagctgattaaaaatgagcaaaggacctgaaaagacatttctcaaatggaaacatggaaatgaccaagaggaatatgaaaaaatactcaacatcactaatcaccaggattatgcaaattaaaactacaatgagatttcacctcacaattgttagattaactgttatcaaaaagaccaaaaatagcaaatgttaggatgtggaggaaagagaacccttgcaaactgttggtgggaatgtaaattagtacaactactacgaaaaacagtatggaagttcctcaaaaaactaaaaatagaacgaccatatgatctagaaatcccacctctgggtatatattcaaaggaattgaaatcagcatgccaaagagatacctgcactcttatgttcattgcaacactattcacaatagccaaaacctaagtgtccatcaatggataaatggataaagaaaatgtggtgtgtatacagtaccatatataagagtacaatgaagtactatttagccttaaaaaagaaggaaattctgtaatttctgatatgaatgaatctgtatgacattatattaataaaataagccaggcacagaaagaaaaacactggctgatctcacatttatgtggaatctaccaaagtcaaactcatagaagcagagagcagaacggtaattaccaaggaccaggggtggtggtggttcaaaaaatggtgttcaaaacatataaaatttcagttagataagtagaataagttcaagagatctattatattatatggtgactatagttaataataatgcaaagtatattttaaaattactaagagagtagatcaatttaaatgtttgcaccagaaaaaaatgataagaatgtgagatgatggttatgttagtaagctttatttaatcatttcaaatttatacataaatcaaaacatcacattgtactctacaaatgtatataattattatttgacagttaaaaataaaattaaaaaaattcaaaaagtaagaatagaaatgaacaccagaaaaaatttcaggaagaaacaaatagagtttattgaatttagaaaagaaataaaagaaaatgacaaaattacctcaaattttagtaataaattacaccatttagactcaaaagaaaatttggtaagagtcattgaagaaagattagaaaataatcaaaataatttttttaatgaggtaaaaaataaaagaatcagagaaaaagtagtggaaatggaagataggaaaataggaataacatttatattttgggggtcccccagaaaaaaagagaataagactattttttaaaactataacactgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagtttattgtggcattattcacaatagcaaagacttggaaccaacccaaatgtccaacaatgatagactggattaagaaaatgtggcacatatacaccatggaatactatgcagccataaaaaatggtgagttcatgtcctttgtagggacatggatgaaattggaaaccatcattctcagtaaactatcacaagaacaaaaaaccaaacaccgcatattctcactcataggtgggaattgaacaaagagatcacatggacacaggaaggggaatatcacactctggggactgtggtggggtcgggggaggggggagggatagcattgggagatatacctaatgctagatgacgagttagtgggtgcagcgcaccagcacggcacatgtatacatatgtaactaacctgcacaatgtgcacatgtaccctaaaacttaaagtataataaaaaaaaaaaactataaccctaggaaacgttctagaaaaaaaaaagattactcaagagtactatactttaaaaggacttatcaggtgcctggcaacattaattcagaataaccaattctgagacatatcctagtaaaacttttagatttcaaagatgaagaaaaaattttcagggcctccagcaaaagatcaaataatttacaaagataaaagaactagactgccatccaattttcaaaaggaaacatacagaggaagataaaaatgaagcagcattttaaaaaaaagcatcaagactatcagaaaacagttttcaacatgtaagaagcaagggaattttgtatccacaagctcttcttgaagaatttattagagaatgaacttaatgtatcacagtgacccaatctgaaacaatttgaacaaaaaagtaattaatgatagaaatggataatacactatataataaaataaacacctatgatgccatattagcataaagaaacacaggggaaagaccagcttttccttgtattataattctaattaatacacatagaaggaatgatggaaaatgaaagaaaaacattaagcaaacactatagtaaaaattattacaggcaagaatgatgaatagtggacaaactattggtggactgaaattagtggacaaacatatgaagacatactgtatatttacatagagttaaagcattttccctcaagatagttgttaattaaaacaggaaaaggcagggtgtggtggctcacgcctgtaatcccagcactttgggaggccgaggcgggcggatcacgaggtcaggagatcgagaccatcctggctaacatggtgaaaccccgtctctactaaaaatacaaaaaaaaattagccgggcgtggtagcggtgcttgtagtcccagctactcgggaggctgaggcaggagaatggcgtgagcctgggaggtggagcttgcagtgagccgagatcccgccactgcactccagcctgggcgacagagcgagactccgtctcaaaaaaataaaataaaaaacaggaaaaatcataactttactgtggagaaatctggaaataaaacacattaaccaaggaatcaaatttaacatcatcagtagtaagacatattgatacctcctcataatgatgcactgagcaactgaaattaagaaaataattccatttacattagcataaaaatgaaatgcttagaaatgtacttaacaaaataagtgcatgacctatacaacgaaaactgcgtaagattgtaaagaaaaatttaagaataaattgttactgaattggaagtttctgtatatttagatagtaattatccacaaaattgatatatgattcaatgcgatcctgatctaaattctatttgactattttataaatttgataacctgcttttaaatttatgccaaaatgcaaagaatcctaaataattaaaacaaccttgaaaaggaggaggaagattgtagttataatgactgatttgaagactactgattactgtaataaagcttcagaaatcaacatagtgtggttgttgtaaggattgatccatggaagaaaatagaaagacagaaaataaccaaacctacatggcaagtgaatttcaaagaagctgccaaggcaatgaaatgcattaaaaaagagacttttcaacacatgatgctggaacaactggatatccaagtagaaaagaataaatctcatctagaaaacaaaagtgcaaaatttaaagaagaaaatattgatggaattcttcgtgatgtttaagtgggagcttttatttatgtggggcaaaatgaaaagcacgaactgcacggataagaaagttgataaattgtatttcattaaaattagattcttctgattcttgaagaacatctttatatgaaagggataactatgacctgggagaaactatcgcaatatataaatacagaaaactcttaaaactcaataataataagcaaacaactctattcaaaatggttaaaagatgtatgctaacactttgcaaaggaatgtatatccatatttagacagtaaggacatcaggaaatgctcaacgttgttagatatcagaaaaatcaaaattaaaactacgaaaatggtcagaatttaaaagactaacagtaccaaatagtggcaaagatgttaaccaaacaaaacaaagatccccagcagctggtggaaatataagatggtacatccatcatggaaaacattttgacagtttctcataaatttaagtgtttatttactaactctcccaaaaattcaactcctggatacttactcaagagaaataaaaacatgtgctcacataatgacgtgtgctctattcataataacagaaaactagcaagaaccaaatatccactgacaggtgaatggagaaccagactgtgttacatccatacaatgaaaaatggaaaattaccactcatcaatagaaaggaagaagctgctgacccatgtaacaacacagatgatttgcaaaaacattgcactgaacttaaggggctcgacacaaaagagtacatagtgtatcattcggtttctttgaaattctaagagaggcaaaactaacctatagtgacagaaagtgtaccaatttttgcccattgttaggggttgggaaaattgactaaaaggggacatgagggaatttttggggataaaaatattctgcattgaaagtagtgatggttgcatgggtgtatacatttgtcaaaactcattgaactgtgctcttaaaatgaatgctttttattggtgtgtaaatataccttgataaaactgattttaaaacaatcacaccttagaggcaggctcaaagcatagcactagctctcattcatatacatagtttggctgcttgagaataatacagtctggaacaattctgccagtccaactgatcttcctattttctgtctcctcaaaactcaaaagggcaatgaaatgactttgaaaattctctgactttctagtgctaggagcactttttagaaattctgtgtggccagtggagagcacctgagaagtccatttgctcacagcaaagctgcaacctcagacctgaggtctggggccagatctccagctgtgagagaggagaggacggctcagttgcagagggtcagagtagcaggaaacctgacaagacgtaacacaggaggatgctaatcttagggtgtgaggttacagttagccacagcaaaggtgtggcactgagaacaagctttctcgttgtttctgggctgcctcccagtgctgtgttaaagcttcttggctaagacttctggacaccagcgtggagccaggcattcattcagaggtcaggtcttgcctgctgtgggttcctcctacacggcaccagcgggggctgacagcaggcccctgcaagtgcttgataatcagctcctcttttgcctctagtccagtcgacattttcttccctccccagtcagtgggggaggacaatcaattcttcatactgccctggaaagggatcgttatagtgcagccatttgcctgacagctatgctcactctgggagctcagcctctgaggtcatttgtttgccaactgcacctgcttttatgacttttcctatgtcttgacaccccttccttaaatcttcaaaaaatacggaccttagattattgactaggcatttctgagtctgaacttccattttcagaaagttgcaaatagctttcttataaaagtttttaaaaatgcaggtaagctttcttcaaagtaatatattcttatagatatttctaaaggacagagaagtaaaaaagaggactttaaaatcacctttaataccctccccttaaagtaaaataattgccatttacattttattgaatttccttctggtagggacttaatttatttgtgctctggcttgttgccagaaggatccaggatagttcacatggccagttcatggcagctaagcccttgcctattttcatttccattatatcatctgtgcttaacccagtacctgggtagacaaagcacttagtaaatactttccaaatagataggtgaataaacatcatcataagcctgagacatttcattccagacttccttatccttttccagcttatccttactctggctggatgggacatatcccagaggtaggccttatttggaaagagaagaatggttccttaagtgatgaatggctcgctggaccaggactcctgataaatgatgccataggagtattttattgtacaaactactcctgagtacatggttggataataagatctaacaattgttacgaatctataatatacttgttacaaattatgttgttacttgttacaaacacaaattactagttacaaattatgcatattaactcatttcctatgatcactccatgaaatggtggctattttatgtctaatttataaatgaggaaagtaaggatcagagagtttacataacttttttaatgtcacacagcagagacagatttgaagctaggctctctggtgccagggcctgaactcttttatccaccacaccatgatgtgtggtcaccatgctagacaatggtcatgatgttacataagcagtggtcaggaaagtccatactcttaagttagatgtgtctggaagtccatttcccactctctgccttgccagatgcagtaagactgagggagtagcaaactccagaaggcaaacacgtgagaaggccacctgaacgcggtgggtggggagtttgttgctctgtgggacacctgagacacactcttctcctgacagagcactgatggccactgaagcttctttttcttaattagtttaagttctggggtacatgtgcaggatgtgcaggtaccttgctacacaggtgcacatgtgcctcggcggtttgctgcacctatcagtcaatgaagcccagcatgcattagtgatttttcctgatgttctcctcctgccatccgccctccccaacagaccccagtgtatgatgttccccttcctgtgtccatgtgttctcattgttcagctcccatttataagtgaaaacatgcagtgtttggttttctgttcctgcattagtctgctgaggataatggcttccaacagcagtgattcatagtcacctaacttcagagaggaaacctggttctattgaactctctcctgacttctgatacgttgagaggtagtgagcctggatttcacctcgtaattcacgtggtacaggtagatattctcaccaaaatgacatcattcattcaaacaccgacaactgtagtttaaccccaagattgtaagtggtggacagagaacaggtgaacgcagacttcacggccttgggccataccttctaaaccaggagacacacaggacacatcaaactcatagcagggaaatacacctgctaacctttagtaggtgactcatctactacattcactgtggcagaatctcataaactaactcaggacaaaactgacttagtttatgaaaagacagcatagccactacagatttctagattctattcttaggtcttatctcttgcaccgtcaataactcaataacaggtcagtatttatttgaatgccccacagcatgtgcggaaggcccatttctttagcatgttaagaaatgacattagtaggctgggcgcagtggctcccgcctgtaatcccagcactttgggaggccgaggagggcagatcacgaggtcaggagtttgagaccagtctgaccagcatggtgaaacctcgtctctactaaaaatacaaaaattagcgcggtggcacatgcctgtagtcccagctactcaggaggctgaggcaggagaatcgcttgaacctgggaggtggaggttgcagtgagccaagttctcaccaccacactccagcctgggcgacagagtgagactttgtctcaacaaaaaaaaaaaagaaatgacattagtaatcatggccatacatcattcaaataccacctcttgagtcttttagtatgtgcttggccctgcagttagtgtttagaccccttaacagggtgatttggtaaaagttagtaagcagttaagctgcatagctgaatgtgatttttaactgtactcttaatcgtggtggcattacaagaaggatgtatggtagcacagggctggagggagaacaccaatggacttcctcttagccctgcacattcgctctgctcaccttatctaggagctgaacgtcagtttgttatcagaccatcaggtgatgctgtggatctgcgtggtgcgtaacacgtggggtgatgaacttcactttacgccatcccttgctttgtctcaagatccacccctttgtcctattccccgggggtctgtgcagttattctgacaaatgttgtcattcaaagaaaaaattgctggcaacccaatgtcacctgtacctattggtggggactgagcatgtttgcagaaacaggatacctaaatcctagcaaagtgcagtacgtgcccaacaaatacaagttatagctcagagaaacacaggtcctccccgtgcgggccacacaatagactagagattgcttttacaaaaacctgcaataacgcaatataataagtaaaaaataataacacagaaccaaagttccattgtggggcagtagctgctttgattgggccacggttgtgtctagagtcttgaaaagcctccactgttccttcatgtctttctttaatattctcttgcatacatatgtatgtattttacaggtgagcctatgactattccttcatgtctttctttaatattctctcgcatacatatgtatgtattttacaggtgagcctatgattgctttgattcttaccagataggatgttatccctcagcctggaaacatttgggtcatctgttgaatacatagctaataccaactggtaattttcatgcagagtgtagtataatgctttctccaatacatggtttagcagcaataaagaaaatgttaccattttcatcactgtcatccagcaacaactgaactgcttatcatgatcttctcctgccatgtgtggagatagcctgagaagatcaacaactatcaaggaggcattggtgagtataaacgatcattaattaatcatgttcctgctctgctagactcctgactgatatattgaaacaaagtttcttgctgaagaataagtagtatgaatgacactgtgttatttaataatggaagactccatgaaagcacaagacatatacatggttgatgggcattcagagttgctagtttcaaccagggatcacatttaaacttcagtgaataatttattctggaaaactctcacagagcagtaaatggcctccatattttgtagagattttcttctcttagaagtttataagaacactctgtgtgctcaatatttcagaaggggatggtttttgattactttatgccctttatacttagcagcccagcagttctcacctacagccagcattgttgggatatcattttgtttccatggcattgcccagatgaattgtctgggcaatgcaggagtggaagtaaattaactatcaagagcaaatggaagattcacttcatcacttaccagagacaatatatcatcagcattttcttgatttaacgtttgtctgggtcttgtttctaatacattttttaaaaatgaatatacagtaacatactatctgcctggcatcatgaagaaatgagcgatatcattgacaataataaattattttttctaattacgagaatgatcttattttgaaaatgaaatgttcaaaaaagaccaattgtgaaaataaaaattatctataatactataattacagcaatcgagacaacagccttaaccatcctatcgtaaattgttttagcttttttttttctattcaggctacttatatgcacgcatgtgcatatgatttacatagacttaatgtgcattctgttttataacattgtgatttaataagccataattacttttgtatgtcgtccaatatttttctaccttaaacattttgaagaatacatagaattttgtctttggagctattctaacttatttagtcaataacatagtgtaaaatatttattgtttttaattttaaattgttttaaattgtacaataataagcaattactgagaaccaccttggtacatctctatacataatccgaatatttccttaaatgaaattcttacaagtgagattgctgtcttgaagataaagtacatttttaagtcttttaatacatattgcaaaattactttccagaaagattgtagtgatttacattcaaactagcagttccatttcctcaagtcctctccaaaactagctatgtaatttattatgtgtttcttggcaaattgtaaaatatttttgtatcttaatgacattataaattctattttctttattactggtgatgttaattttacatctaatgtatattctctttacctttttattattttgcggggagtctctttccttttttaaaattaatttatttatttttattatactttaaattctgggatacacgtgcgtgcagaacgtgcaggtttgttacttaggtatacacgtgccatggtggtttgctgcacccatcaacccatcatctacattaggtatttctcctaatgctgtccctcccctaacctcccactcccgacaggccctggtgtgtgatattcctctccctgtgtccatgtgttctcattgttcaactcccacttatgagtgagaacatgcagtgtctcgctttctgttcttgtgctagtttgctgagaatgatggtttccagcttcatccatgtccctgcaaaggacatgaactcctccttttttatgactgcatagtattccatggtgtatatgtgctacattttctttatccagtctatcattgatgggcatgtgggttggttccaagtctttctaaaagatggtatacatgtattagttacccatttttatgtaacaaattaccacaaacttacaggctcaaaacaatacaaattcattttacagtttctgtaggtcagaactctaatgtggcttagctggtcccccatgtcagagtctctcacaggccaccaccaaggtgtcagccaggcctggggtctcctttgatagttcaataaggagggatcgtcttctaactcacctacgtggttttggacaggatctgcttcctttgggtctgccttttactcacgtttccattgtcacctcttgatattgtcagttttcttgcctcttctagtaacttcctttctctctgggagagaatgacctgactaacaaagctattgaaatttggttatgcaataattacaaggcgtcttattaattatttgacttggcatgtttgctagataggtaattacactttgtcttgtttcgtactgctattaacattccagaaatgtaccaacagtaacttctcccctatctcctccctcttctactctcaggaggcaaccaggcctcaatttccaacatctaaatctctttgttcctggggaggagttgagtgtgtgtgtgtgtgtgtgtgtgtgtgtgtgtgtgtgtgtgtggactctgtaaaagaagttgccaggagcctacacaaataatacctaagggacctttccagtggcaactttagagcatctttataagggaagtctcaggggtcaatcttcttggaaaggagaaatagagtttttttctgaagccaggtttactgaggaagtgcattgtttttatttacagtgcatatttatttgcagtaggggaaagctacagactcctttaatcattggtatctatattttacagctaccaacttttaccatcacaaagaataaatgacaacatggccccgatcacactactgggttggagacctggagtttgaagcagatcgtcttctattaaacacatgatgctctccagtagaatagctgaaagagaagacacttcatctttaaatcctcgctgctttattccaaatatatccaatgaggatttttatattccaggattctcaatgtctctgttgtcacaaaaagaactgtaatttaagaaccctgagtttttgttacattaactggttctatggtagaaaaagtaattatctgcctaatatcacatttttcatcttttttaattgacaaaagtcttgcttttgggttactcttagttttggtttgtttgttttgtggtatgtgcgtgtgtgtgtgtgtgtgtgtgtgtgtgtgtgtgtgtgtttagggcaccaactgcattgagctaaaatataacatttttcattgtaagttgaactataaatggtcatatgactgctgtggccagtgagacactcttagccgggaatttgagaaaggcttcttcaacaagggacagggagtctgaaggcacgtcttctgcttcttcaacaagggacagagaggttgagggctccccttctgcacttccatctccctgctccttgccacctggcatgtggatgaaatactgcagctccttccttggattcacgggggaaaccaagcaaatgggaacatggggctgctgtgccagtcctgggcttcccaccttggatttattttctgcgaaacgaaatatgttcttatatgtggacgccactgttaattgtttttcttcttatattcagccaactcctaactaataaactgtgtaatttgtgaattcacacctctgtgcctaagatttcatacctgtaaaatacattcctatgagaggttggaggaggaattggcatgatgattgggtgatttaaagagtcctcttaaccctattattttcttgttctatttagattccaattatcctacctattccaaagcctcagaatattgactcataagtctttcattagcctcaaaatgtccaagttttagtatgagtcacatcactaaaaacacaagaagagatctaatcctttaaggtatttcctcttattagcataataaagcctcattaaattagattttactataaaattgtgtggcaatttggatagaggctagatcaaaaacggagtcaactttttaatcagaaaaaaactttctgaacaaattgaaactataaataagacaacttatacctgctttggagaggaaacggttctcaattactgtagaaaatctatttacatagaattaattaatatcttaattaaaaatcattttccccaagcttattaagttttgctcattggcaacattttgctagctgttcttcacttaatgttggaataaagctggaagtactgaaacctcacagcttttgaagtcttacggaactcatacaatattaactagtttatctaaatcaatgagatttgctcttggttaatttatatctcttttagatgtagaagcagtagaaagattaaatataataccttgttcttaaattattaatatttcagagtttttatttcctacaggttatgacacttcaaggccctcttagaaaatggcttgggagaaagaaactaagaatttcactgaaagataatagaagcactagctccttaggataaatgattttcttcctgttttcctattgcagccaggaggaagtaaaaactgatggtaatactgaaatgccaaagaggactcatgagctgtaaaagtttcatctcagtcatgggagtcatttgtgacacaacaaagacagagatttttctgttgttcataagctggtttcctaggtatttcatttttattgtggcattttaagtgggattataatcttgatttcactctcagcctggacattgttgctgtatagaaatgctactgagttttgtatattgattttgtatcctaaaactttactaaagtcatttatcaattctaggagcctttggcagagtctttaggattttctagatatagaatcacactgtcggtgaagagagacagtttgacttcttttttcctagttggatgcgctttatgtttttctcttgcctgattgctccagctaggactttcagtactatcttgaataggagcgatgagatgagcatccctgtcttattccagttctcaaggggaatggtttgaatacttgcccattcaatatgatgttggctgtcggtttgtcatagatggctcattattttgaggcatgttcctttgatgcctagtctattgacagtttttatgaagtcatgttggattttatcaaaagctttttctacatctattgaatttatcatatggtttttgcttctcattctgttcatgtggtgaatcacatttattgatttgcctatattgaactagccttgcatcccaggaatagctggacttgctttgctcatattttgttgaggatttttgtgtctatgttcatgagggatactggtctgaagtttttattttttcttttttccattgtgtgtctgtcagattttggtatcaggctgatgctggcttcatagaaggagttagggaggagcctctcctcctcaggtttttggaatggtttcagtaggatgggtatcaagttttctttgtacatctggtagaatttggctatgaatccttctggtccagtgctttaatggttggtaggttctttattactaattcaatttcagaatttgatattggtctattcaggatttcaatgacttcctcattcaatcttgcgtgattttgtgctttcaggaatttatctatttcctcttgattttttaatttgtgtgcttagagttgttcatagcagtctctgaggatgttttgtatttctgtggggttcattgtaataatatcatctttgttgtttctgattgtgattatttggatcttctctttttcttcatcattctagctagaggtctatcaatcgtatttatttttttgaaaaacaaactggttttcattgatcttttgtatgaattttcacatctctaattcattaagttattctctaattttagttttttttttcttctgccagctttgggattggtttgttcttgtttttttctagttccttttggcgcaaagtcagatggttaatttgagacctttctaacttcttaccgaaggtgttgaaggttataaactttcctcttaacactgcttctgttgcatcccagagattttgttaagttgtgtccctatatttattaatttcaaaataaatttactttctgcctgaatttctgtattctcccacgagttaaccgggaggaagttgtttcttggctgtgcatgactttgggcatatcctctgagagtgagaaataagttgttttcaaattgtctaaaaagcaccacaaaaaatgtgggttactttttttctttaagctctctaagctgaatagattacattcaataaagattcatggggaagtggaagttctgcaaatttatttgatcccgtctgcatgttctccagagtactcatctgccctgacccttcgcctcctcacgcagggctgttacagaagttcagctgtaggaaaatctgaggacaggggaaagcacaggcagaaatgtcccttcccatttgaatttgtgttctagatcttttgggaagtaaagagttaaggccaaaaatttgtttcaatttctatttacttctaaaagcccatgaattacagcttcatttcctgtcctctttttacccttctaagactttcttgtgattgattagtctgtccctgaaggtcacatgtaggttgaaccctttttattgaaaaggtgcagctggatccttcctcagaagaaaaagggactctgccagatatcaaaacaacaaatgtcaccaacccctgccaccaaaacatagaagctatcagccctctggtatttattattatttcagtttatagtggtctcaccaagagacacagttgcactgttattatcattattattattttgagacagagtcttgctcttgtcgcccaggctagagtgcagtggcacgatctcagctcactgcaacttccgcctcctgggttcaagcaattctcctgcctcagcctcctgagtagctgggactacagacccccgccaccacacccagctaatttttgtactttttgttagtagagacagggtttcaccatgttggccaggctggtctcgaactcctgacctcaggtgatctgcccgccttggcctcccaaagtgctgggattgcaggtgtgagttgcactattattagttcaaggtgatgacagatattgtggtatctttatacttaatatttaagatgcatacacgatattttctatggaaacaaacaattgcaagtgtgttgtgtctgcacacatgcatatgctaccactcactcctactctctgtgatattcacaagagctcactgactccatttgatcagggtgtgcatatggtgggcaccttctatacgatgtgcagtatgtagatgaggtttggagggttgtggcctgtctttcctcaatttggaacgcctctgaagggtcttctgtgacctaggacttccatgggttttattgagacttcaggagccaacataccacctttcaaattctttctctgctcaatctgtttttctctgtcctcttccacaggggttgatcctgagaccacacccaagaaacttcctgcaagcaaaactacatttcagagtatatctcctggggacccaaactgtgaccatttttaaacattgccttactctgtactctctggagttgaattcctatctaaacatctaaactttctcctcttactaccgggtccccagcatctgtcccattcttgcaggtttgttttatggtgtagccaaccatgcatcgcgtgcctgtgtgcagccgtgctgtgctttatggcatgcacgagcagctgaatttctgaaaatcgtccaacttgggaacttttgatctatcagtcctctttgtgtgttgagtatgggctgtaattttgggggcaggcaaaagtatattgtattggtcagttttgctgtcataatacccaccgccccatcttagcatcttgctcaaggacgtttcctgctgatgtctcatgttggtggcagcagtgctgttaggtgtcttctcactctaggatccaggctgaaaagcagctctgagctagaagatgccatcctcataaaagagaacaaagagtaagcatcagctccaagtcacatgataacctttaaagcttcagcctggacaggtgtatatcacacctgctctcatttcactgccaaagacaactcatgtgacccaggattactgttgggtgacagggaagcattgcaagtaacaggcaatgagtagtttgcatcatccttgtacagcttgtacatccttttattgcttgggaacaataaaatgacatatccaaaacacctctatccaaaataccactcccatatgtctgtcactgccattaaaattctctgactttgaattaaggcactgactttcctgaaggcttccattaaaacacaaacattttattcctgagaagtaatgcatttgtccaccatcttatttacattaattattttaacctcttcatatttttgctccataatgcaaagcagcagttcgagtctgagaggttgacagtgagatgtaaagaagtataagtgaaatcacattctgtcttcttatgtgcctaacctatttattctggtgacatcttgttaaaatgatcctcttgaattgcttcctagaaaaaaaataagaagtaaaacttacatcataaaagttttattattaaagttctcagattgtctatataattactaaaatttattgaatgtttagtacttttttttttttttgagtcagagtcttgctctgtcacccaggctggagtgcggtggtgccatctcggctcactgcaaccttcgcctcccgggttcaagtgattctcttgcctcagcctcccaagtagctgggactatgggcatgcacaaccatgcttggctaatttttgtatttttagtagagatgggatttcgccatgttggccggctggtctcgaactcctgacctcaagtgatccacctgcctcggtttcccaaagtgctgggattacaggcataagccaccatgcccggactgtttaatactattttattctgcctccttatatttaattgtcataatatgcctgtaagatagacattatgattttcattagttataagaaggatttgtaaaaaattttagcaactatataattcgtatgccttataattgctgttgactgggtggcagtcacattccagtggtcactgcacagggaatcaggatggagtattgtttcctaacacattcatgactgatgctctcgggtatagagaaaacaggagcattgatgaaagagagtgagaaaagttcaaacagtcaaactttggatgtgacaaaattttaataatacactaacctagtcatttcatatatatatatatatttagttttgcacagcagtgacacacaataaacaccactattttattatttatgcctagtgttccattattggaacgctaagcaaatgggggttgcatcctactgcttaaggtcatcggcaaggtctgactgcaaaaattcaaaaaactgcaacctcaggcataagtgggttaagcttaaaagagcttttcaaaagttataaaaattctgataagagtattttgtcacaatctaattgctaagtttattttaattagtacataaatgataagacttacaattggtggtagcttagatttgatgagaaacacttttattaaagccaatttacagctgaggaaactaaggtgcacagaagctaagtaccttgcctaaggccatagaactcagggtttctgcaatagtcactttattccttgtctttcctaaataactgggctccagttctttttagcaccaccttctctgaaatgagacgaagggagctgtaaaaagagtagagtattgattttgacacaattctctgtgtcctccaaacacatacttttccacaaattaatcaatgtggtcttctgcaagttacttaaaatacgtgaacctacgattctccattagtgtgatgacaatcaccacacctgtgaggatcaggcgctaacgtaatgcaacaacaggaaatgtaaatagaaacgtgacacggaccctggcatcaagtccatgctccaggaagtcagttcccttcacctttcgtatctggaaacctcaatgggtcctcatagcctgtcaatcaatatctttcatggcttactcctagtctggccaggatcagccctgcttcgtactgcacggttgagaatgctatgacagcagaggcagctcttatttttgatgactgcagggcaagtgttaccttaagcttctggccagaatgtctcattagatgttacctgtagagtcgcagagccactttcttgaagatctgaacaaaagtataaattctgaaaagatattaaactgtgcattgctctagtctaaaattcccaagtcaaggtgattgccatgaagagagggactttggagaattcagcatgattagctggtgtaactttagctctcagtagggaagcaatatcagagtgatcaaggataccccaatagaaatgccatggcctaaggcagcaccaataaatctatcaactagctgttattgagtctgtaatgtgttcaggatttaaaatgagccctgaagaatctcagtaataagaaagaacagacaaacttatgaggaaatttatattcaaatgtctgttgtcttctattggttgctgatttgttgagtaaagaccaaaagtatgttagttactcatagcagagctaattagctagcaaatgcttcccagggtatctcagaagggtagagatgatttattaaggcttagggcctgagaaaaggcagtgttgggagattgtctggttctttcttttttttgagacagagtctcactctgtctccctggctggagtgcagtggtatgaacttggttcactgcaacctccgcctccggggttcaagtgattctcctgcctcagcctcctgattagctggaattacaggtgtgtgccaccatgtccagctaatttttgtattttcagtagagatggggttttaccatgttgaccaggctgatcttgaactcttgacctcaagtgatccacccacctcagcctcccaaagtgctgggattacaggcatgagccaccatgcccagtctggttctttgcttaggtggagaactcaggcccggggaacacagagggctcgcagtgtgtgaaggcagcatcatatcagtggggcaagtagggctccgacatggttttctattaagtgtttctgtacgttaacttgttttttaaaatcagttgactctctctgacaacattgtttgctcatgtatttaatctgatgggcaattattgagccactgtctacctaaatacctacttagtaataggataaactcaaaagatttggaagatctatattatgtcttatttccccaacgaaaccatgagttattttgttcgtaaggactgggcaccgtatgtgtgaaatacattacagatatacgattagatgtgataacctaaggcaaatcacgacccagagtgtatttacaagacttgcccctcctttatttcttcccttttgatgattggcgtcctttccctacgacgattcccacttatgtcagataaagctttaattgcctttctcagacaactcatttatacttaacagagttctccagtgctgcagaggtctcactaattatgaagttttaggcaaaatggggcagttgtttcctggggtgagagcagatgggggtatctgtttctttctcagtactcacttgcttgatgcttgtctacacttctgcttattatcagtagtgacaatagagtaaaattgtcaacgtgaatttagcattagtaggtgttggggcaaatggggacttagagataatttaattcaccatgttgaccaggctggtcttgaactcctgacctcaagtgatccacccaccttggcctcccgagtagctggaattacaggtgtgtgccaccatgcccaactaatttttgtatttttagtagaaacgggatgaagttttaggcaaactgcggcagtttttctacttttgaaataaataattggggaggagagattgaccagctcccataagcagacggccctctgaggacaacagcctctagtccctttaactccctgctcttgcccatcctgtgacctttccactcttgcagaaaaggtaattcagttcctcttttaatttcttcttgctgcattggaaaaaaaaacaactataaataaaaagtgggctgtcaatattcacaaaatctggacacgatccactctttcaggcccaatttatatctcccttcctcgaagaacatcttctgatttatctgggcttcaatgaactttatctctctggagcatctttaaaatgtatatagtcacttccacataggaaacgacttaagaattataatgtggtggactaattgttggttttgtcttactgattggattgtaaacttcttaagggtagtgaaccctgtcgtctgtattcttctcagggcatggctgcactgagcataacacggctgggtgaccacattgtattccagagggcagctgctaggggtcatactctcctctaatacgagtagacatgtttcttgccttcatcataagttctcaaaatctggctgatttgaatttgtattcttctactatccagagttacttggtagaaaaatgaggaccctctaggaattgctggagtaaagaaacaaagtagggcaactattttctgtaagcgaggccctaacggcatttagagacgggagaagaggaagccaaaaaatcttcctcaagctcaatttcgaggcctcgggaggcacaaagaagtgttgtaagttatttcaattacaggaagtaggcttaaaaagctaaattaataattgaccattttaaattatttaaacccgtagttcttaacctcttttgaatactggacccctctgagaacgaggaaagctacagatcttatcttgaaacaaatggatatacacacagacgtttgtaaataaactcaagagattcatggccacctaatggccatccgaaagccctgagctttgatggcagcaaacagggggctcattttcactctcaacagcattcctggcagcagatttaggattaaaccactgaaaccaacagccagagctgatgcatgaaaagatactctatcttaaagcctcataagtagcttctcatatgaaaaatgttattattctttagtgaggaggagggctggaggaagtggcctgcattttctaggcattaaagcctcatatggtgatctgggaaaggcactaatttctccgaagggctctagcaagttaaagaaaacagatatgggccaggcgcagtggctcatgcctgtaatcccagcactttgggaggccaaggcgggtggattacttgaggtcaggagttcaagatcagcctggtcaacatggtaaaaccctgtctctactaaaaatacaaaaattagccaggcatggtggcacgcacctgtaatcccagctactggggagtctgaggcaggagaatagcttcaacccaggagttggaggttgcagtgagctgagatcgcgccactgcactccagtctgggtgacagagcaagactccgtctcaaaataaaataataaaataaaataaaataaaataaaataaaatgaaataaaataaaacagatttaagccaactcaggatatatttggaccattcatgcattgacaggtttatttcccttggacaatcagattccataagaatagtgcaagttcaaccccaaaatcccgttaccctcttctctgcagatttctggtttccagtttacaaaggaataaaagtttacctctcatggtggggaatgaggagggcctagaaaatgaggtcaagaacttcattgggatgaggattgggagagagacagagacaccctttgtgtcaagtaaatgatctggagctcaatggaagccttcaggggaaaggaggaagatgtcactccaggaacgaggacatccaatgctagagcaagagtctgcacctcacaaggagctggagaaaccccttctcacttcaaaatgctttgcttgaacattttcagttgcaagtggaacttcaatacaagtgattatttatcaaatacatgtgtcatctcggtagggctgaaagacccccatatgaaaatgtgtctttatctgaaaccgtaattttttttcttctttgccttgcattatttttaattgacacatgatcattgtacatgtctatagagtacattgtgatattttaatacatgcctacaaaatgcaatgatcaaatcagggtaatgagcatatctaccaccacaaacgtttatcacctctttgtgttggggacattcaaaatccgctcttctagctgtttgaaaatatacaataggtcattattaattatactgacggtgctatagaacactagaactgatttctcctatctagctgtaattttgtatctgttattcaaactctcaccctccctctctccccattcctcttcccagcctctggtaaccactattcttcttttctttctccttccttccttccttgcttctttccctctgtccctccctcccccctccctcccccctccctcccttctttccttccttccttccttccttccttccttccttccttccttccttcctttctttcctttccttttggttttttcagagtcttgctttgtcgcccaggctggagtgcagtggcacaatctcagctcactgccaactctgcctcccaggttcaaataattgtcctgcctcagcctcccgagttgctgggattacaggcatgggccaccataactggctaatttttgtatttttagtagagacagggtttcaccatgttggccaggctggtctccaactcctgaccccaggtgatccacccaccttggcctcccaaagtgctgggattacagttgtaagccactgtgcccagccaactattctactttgtacttctatgacatcaactatgttagcttccacgtataagtgagatcatctggtattcatctttctgtgcctgacttattttacttaatataatgtcctttgaattcatccatgttattgcaagtgacagaattttattcttttttatggctgaataatattctatcatatacatataccacattttatttatccattcatctgctgatggacacttaggttgatttcaatttttggctattgtgaatagtgctgcaataaacatggcactgcaggtacctttttgatagtatatactaattttcttttctgtgtccatatacccagtagtgggattgctggatgatctagtatttccatgtttagttctttgaggaaacttcatactgtttcccatagtagttgtactgatttcacattcctactaacaatactataaaagttcctctgtctccgcatccttgccagaatttgttatttttgtcttttttttttctaataaccattctagctggggtgagattatatcttacgtagttttgatttgcgtttctctgaagatcagtgatgttgagcatcttttcatatgcctgtttgccatttgtattcttcttttgagaaatgtctattcagatctttttttccattttttaattggattattggatttttttcctatagagttgcttgagctccttatatagttggttattaatcccttgtcatttccttagttaaatgtattttgaggtattttttgggtagctattataaatgagattgctttcatgatttctttttcagtgagttaggtttatagaaatgctactgatttttgtttgttgagtctgtgtccctcaactttactgaatttgtttatcagttctaaaggttttgtgctggagcttttagggttttctacttataagatcatattgtctgcaaagagggacaatttttactttctccttttcaatgtagagagttttttaatttttatttttattttaagttctggggtatgcgggcaggatgtgcaggtttgttacataggtaaacgtgtgccatggcagtttgccgcacctatcaacccatcacctaggtattaagcccagcatgcaatagctctttttcctaatgctctcccttccccacctccctgccccttatttctttcttttgtctaattactctagctagagcttccagtattatgttgaataagagtgttaagagtcggcatccttgccttgttccagttcagtttcatcacatttcagtatgatgttagctgtgggtttgtcatacatggcctttatcatgttgaggtacattccgcctatgcctaatttgttgagaatttttatcatgaacgctgtcgaattttatcaaatgctccttctgtctattgagatgatcatcttgtttctctcctttattctgttgatgtgatgtatcatgtttattgatttgagtatgttgaaccatccttgcatccctaggataagtcccacctgatcatggcaaatgatctttttttaatatgctgctagattttgtttgctagtattttgttgaggatttttgtgtctatattcatcgggaatattggcatatagtttttgtttttctcttgtgtccttgtttggttttggaattagagaaatcctggcctcataaaatgagaattcccttctcttcagttttctggaaaagtttgagaagaattggtataaattctttaaatgttcagtagaattcagcagtgattttatctagtcctaggctttctgtttttgtttgtttgtttgtttgttttaacttttactttaggttcatggggaaatgttcaggtttgttatataggtaaattgtgtgccatggggtttggtgtacaaattatcttcccactcagctaatactgattcaatcttattactgtaattgttctgttcaggtgttttatttctcggttcaatcttggtgggctgtatgtgtccaggaatttatccatttctgctaggttttctagtttgttgacatatagtcgttcataatgtaatctctaattgcattctgggggcgagaggtgggggaggagctcaatatttaaaagaatacaaaatgttcagtatctaacaagttaaaattcacaaagtatggcattcaattaaagattactaaacatacaaagaagcagaaaattacagctcataataaggataataatccattgaaactaaacaggaaaaaacattaatgttagaattagcagaaagagacattataatcattgtataactgcattccatgtattcaaaaagctaaatagaagcatggaagttactttaaaaagaaatacatcaggccaggcacagtgtctcatgcctgtaatcccagcactttgggaggtggaggcaggcagatcacgaggccaggagtttgagactagcctgaccaacatggtgaaaccctgtctctactaaaaatacaaaaattagctgggcatggtggtgcatgcctgtaatcccagctactcaggaggctgaggcaggagaatcacttgaacccacgaggcagaaagttgcagtgagcggagatcacgacactgcactccagcctgggcaacagagccagattctgtctcaaaaaacaaacaaataaacaaaaaacaacaaaaaaagacatacatgacatttctagagacaaagactacaatatctaaaataaatacagtgaatgggattaatggcagattaagcattcttaattaacattagtgaaattgaaaacacaacaatagaaaccatccaaaataaaacttagacaaagaaaagattcaacagaaaaaccaatcaacaaatcatcagtgagctttggggcaatctcagcctcctatagatgtgatcagagtgcctaaaggaaggtaggggtaataaaagataaatctatgaagaagaaatgactgacaaatttcaacaaggtaaagggatgaattggccttaaacaaagtaggactcggcagagagcctggcaggccctggcttccacgaggcccgcaccatgggctccggatgcttctgggccaagcatcctctcctgtgttagtagttggtttttctcatctctacattgctatttcctaggcactctgcccaagcccctgtgtcttcaagtttatcaggaaggtgcctgagtgtctctcctgctggttttctccctgggaacactttctcagcgtggcgcctccacggcgcctgctccatcagtctggctgcccttggactccttggcagagggcctcagctcctctgcgtgctccagatctgccttggacagcaccatctctgtggccacttgctgctcctttctctgtgctgcctctgcagggtgccctgctggttcagggccatgttaataagcatcagaagtggctccttccctccatccctctctaccacctccaggttcgcagcttgctgaaagccagccatccctgagcatcgtccagctctgcattgataattggccctaacgctctagggggctgcctcagcctgagccccatccctgcccacttgctaccaccgcttactagatttactcctgaagagctcagttctcaagcctcagtttccctgaggtgatcacagcacgaaactcacaaccttccagctcccactctggctatggtcccctctgcttgggaatgcagcagctcctcccctgaataattaattattagtaggaatagattattgataagttagtattaataagtaatcacttaagcacaattacaatgtgttagaagcagcagaggatgtggacagagtttataaccgagagatctgacctcgtctgaggagtcgcaacaaattcccttggaagtgatatgactgataaaacatttaagatattggaataagaaaatgaaagggaggactcaaagaggataaattacagacagaggaaattgaagagtgagaagcttggcttttctgaggacctgaaggaggcttgtgttgctggagcacaaaagataaaggggcagtaatgagaggtcagattgtgcgggtcttgtcgaggccagacttgagtgcttggctcctgtcctaagagcaatgggataaatctttgaaaagctttaaacaaggcaataagatgattaggcccgaattgtaatgggatgactacggaatggattagaggtgcttaaaaccatttaggagacttgcaggactctagatgccttggactggattaggggcaatggaaaaaaaaagaggaagaaaacgccaaagctaactggggcacaaccaacagggagtcccaccgctcagttcgccaagccccgtgtcacttccatgtgaaatgatggagctgagacatagggtgagggtcgggggtgggcacagggagtgggggcaagaaatggaatcatttccagagcctttctatctgcgtggaattattaaagcacaagaaaaatgggagaatccaaaggtctgtaccatgaggcgccaagtggaagggtgtagaccataagttccaggagagatggcctttcttagcaagcaggtggaagctctggctgtgggaaggtctcctggaagcagttgactagagcccagcaaaggcagaagaattcggtatcctttctgaccactgccttcatctagtcccagaaaatcagtgttagatagaagagattctcattaaaataaacagaatttctcacccatgaagggcgattgcattttggaggcaggggaataaagagcttagagaagctgtgggtgtttaaacactcataaaacaaccattttcacttccctcttcacaggtgagctcttctgctcacttaccagttgtacatgtgatgaccaggccccaggacgggtctgaaaaaccacagttaacttggggtttcccctcctactccctgggttttgctgtgggcattggaaaatgtcttccagagacatgataacctttctcacttaatcattaagcaataggaatatttagttttccattttttccccctgtgtaaagtctacaggtaatcctggaaatttttaaattaaactttcactgtaaggggttcacttatctaactttatatcagaatgtacagtcaagacccataacccaaaagcgtctgtaatggttaattttatgtgtcaacctgactaggccatgggggtccagatgtttggtcaaacactattctgagtgcttttgtgagatgatgaacatgtgaactggtagagaaagcaaagcaggtcgtcctccctcatgtgggcaggagggcctggaaagaataaaaaaagactgattctcccttcctctgagtaagagaattcttgctgcctgtcttcaaactcggatgtcagctttatcctgtctccagactccagcggaaacatctactctttctgggcctggtgcctgctggcctttggaatggaactacaccatcagcaatcctgggtcagctcacttcgacagatcttgagacttgtcagctgccataatcatgtgagccaatcccctataatatatctctccctctctttccctctgtgtgtgtatgtgtatgtgtgtgtctgtgtgaatatatttctatatatgcatatatataaataaatatggcataaatatatatgcctctgaagtatctaacaatgtgttttcctctccaacaccattcattacatgtttttgtttttttaaaaataatatgcttcttttgcccccagatcacaaagcaaggcagctttctgttagtccacagtgaaaacagccttggctttaatgcagcagcctgagagagggcttggctaagaccccttgccatccagggctcaggcacaggaaactggttctgtgcacagtggtgttcaatttctatatctctcttgcttcttttctttttaaattattacccttgaaagagttgtggaactagtgtactctgttgtccaaaaagcaatgatttcttttttaagggaatatgcgtgtgacagaaaatgggggctcatccttgtgaatagctgccacagagttattgaaaaattacacttctcaggccgggcgcggtggctcatgcctgtaatctgagcactttgggaggccgaggcaggtggatcacctgaggtcagaagttagaaatcaccctggccaacatggtgaagccccgtctctagtaaaaatacaaaaattagctgggtgtggtggctcctgtttgtaataccagctactcgggaggctgaggcaggagaattgcatgaactggggaggtgcatgttacagtgagctgagatcacatcactgccctccggcctgggcaacaagagtgaaactccatctcaaaaaaaaattacatttctcagcgattatttataaacccatgaacctgctgaaattgaaagcatccagagaagctcatggaccagtctgctaagggtctcatgcctcatacccaacctggatgcatgatacctgagaaggaccattgccctcacgcttccttcaagacactagcctcactctcatgactgtgctttctcagagaaggtctctgaggggccaaagcttttacctggacttcccctgtttctctgtcatttccacactgattacctgggcacctttgttgaaaatcatttgatcatgtatatgtggctctatttctggcctctctgttccgtttcattaatctatgtgtctatcttaacaccaattccatatggtctcagttactaatctttccagctagcttttggataattaaataatttttaatattccatttgtgttctataatgcgttttcaattattcttcattttgttatgagtggttctcctagtatttaaatatttctccatgaaactcatttaccacaagcaatatacaacactgtacatctctttccccttcttgccctttattgcattgctgagaggcatgtaatttctacatatattataaataccctgatacattgttattttgcttttaaaagtaaattatcttttaaacaaatttaaaaaacaataaaccaaatatattttaaatttagctacatattgacaatacttttctgttcttcactttaacatttctgttttaacatttcttggaaggcaggtctgctaatgctaaattctaccagtttttgtttgcctgaaaatatatttgccttctgttttgagggatatttttgctgggtataaaattctgtatgacagttttttacttttaatgctttagagagtttgttcaatgtattctatctttcattgtttctgagatgtcttcattatattttatctttgtttacctatttattattttttctctccttttaagatttctcttttatcactgattctcatcagttttattttaatgtatctgattttattttctgagtgtttaatcctccctgtgatttgttgaatgtcttaggcctataggtttatagttttataaatcaaatttgtggtatttttagctgaagtttattcaattatttttcagcctcacttatttctcttaattcaattacatttatagttgaatttttccaaaggtcactaaatttctgttcactttaattttcattttattgtccctgaaatttcatttcattttatttcatttatttaatctatttaatagactaaattgctgtgtctcaagattactgattttttttccttctgctatttctaattgggtattaatcttctgtagtgagttttaaatattatttaaaaattttcagtgacaaaatgaattttgttttttaaataccttctctttatatcatctttattattttaatttcttggacatattttaattgatttctaaaaatatgtttttacaaattttatcatttctgttatttatggtcctatttctgtttagtgaggttttttcctggtcatgagccacattttcttatttgcctgtctaatttttaaattttgtgttaggcagtatgaatattatcttgtgacattctagattttgttgttttatgacattctagattttgttgttttactttgaagagttttaaagtttattcatttttatcatgcaaataatttacttgtgactcaagcagctggatcctttggaggatttttgtgtatcttttttcatgtgagtctaggatagtctttattctagaattagttttgccctaattctatgcctgagctttttggggtctctgctgtataccctgaggctcaccacagtgtctcccttctcaagagcttgcccaccaaattccaagggctcccaaatcccaatctcagccttctcaatgtagcaagcctgctgtgctctgccaggttgcccacctatgcactgttgttcagagtaattccagatacaaaggcaggggcacgatgcagcttatcttatctgtttttcttctctcagaaactatattcctgcactgtctcttgttcaacatatgaaaagagttcttttatatatttatcctgctttctgattattacagcaagaggtcaatctggtattagttgctcctggccagaagcagaagtgatcgtacaattttgtctacaaagataccgctttgaaacatttctttctatgtcttactgaaagatgtttctatgttggtgatggctttattatatgtatgtttatttttgctattcagctacatagaacacaaatgcacacatcacaaattttgcttccatctctctctcctcaaaatgttttaagctactgataataataatcctctatatttgcatggtatttcagatttcgaaagtgctttcacattctttagctcatccgatttttaaaaatctttatgtaaataaaagattcatttgtcaaatcttaaacttagatatattgggtgaatttcccacagttaagctactagttggtcaagtccccggccaagccttacctaatgtcatatatattttggatgttgcatgtaccaataacaaagggtagcaatacgactgcattgtgatctcatcgcagacatattaggttgtttgagatattctcagggtcgcattagacttttaccaccactcctaccaggaaaatagagctgaataactggtataaaaaaccaatcttcttcataaatcagtttttatttttgcaccaccattgcagtgaggatattatgaaatttacaaaatgggtaggagtcgctgagcaacatgattggtcaataagagcactcagcctgatgtataactctttatgctcatacatgtagacatccattagccacattgcactccttcatattgtcacccataaaaaagacagaaaaggtacttggggaaaagcttcaacactattcttataacctttttcctgctcttgtaacttaatgtaaatatactacaggctttcagatgcctattgcaaaaagaagctgaatggacactgcagcttcagggaaaataaggcactgaattttagacattaatgtcgccatctttttggagacaaaatcagaaaaagtaaactgaaaatatttagtttcaattatgaatcagaaatgaaataataggttattaagaacttaatctctgagcaaaaatatcttgtatgtatgcaaaatggtatgaaattagtattgcattggctgcagggaaggaggataagggggtcattagtgaagaagcagaaagcaaagtccccttaagaagctcacattcactctaaagctataattttctcgtgtgaacatcacagaaataatgcaagacaatgtacacttgtttgtgtagattatacaatgtattcaatataattcagagaattgagaaatgcatgagaatcatttgaacaaaactcactacacagaattgagttttgaactggaacttatttataagacaggagaatttaggataagagagcctgacatccatttaggaaaagaaagcctgaaatgtaatagataggtaaagaagaaaaggcagaaaccaaactctgtcacttactagctaggtaatcatggggaaataacgtttttaaatctcagtttctttttttttttttttttttttttgagatggagtctcactgtcgcccaggctggagtgcagtagcgcgatcccagctcactgcaacctccgcctccgtggttcaagctattctcctgcctcagcctcctgcctcctgagtagctgggattacaggcacatgtcaccacacccggctaatttttgtatttttagtagagacggggcttcatcatgttggtcaggcggatctcaaactcctgacctcatgatccgcctgcctcagcctcccaaagtgttgggattacaggcatgagccaccgcacccggccaaatctcagtttctttatctgtaaaataaatggaggtcatagtacactgcagtgaagtagtttttctgtcaggataggctaagaacacttcagaaaaataaaatcaaaattctcattaagtcaaaatgtagttttattccttattcatgctacatgtccaccgtgggtgagcacagaatgttactcattgtcctccctcaggggcccaggctgacgctgcagccatcatcttaaatgcatttaatctttgggtcagatagaaaagagagacttggaggaagatttcaagtcagcaattaaatgttcagcctggaagtgacatactcacaattcattggccagaacttgccacacctaccacaatggggccaggagtagaatcctatcacatgtctggaatatgaaaaaataaaaaacattttgtttacaatattagtgtttactgcaaataggttctttgaggattgtgtgaaccagtacatatcaaggtcttagcatcatgaatgaaccatattgacttcccagtaaatagtagcttttatagttatgaaggcatgatcctgtgacattttagtaaatacaaaatcacatgctgtctaataattattttaccatattatttgcaatatgtgcaactttaagataaattttattataactattttataaataagaaaacaaaacaattaagcaatttccctcatgttacagctattagccagctaagtatgaactgttacccatggaagtctgactgtaaatgctatttccagtatgcagcattgtctttataaaacttccttttcaattctatgatctgtatgaaatatgtgttttagagttgtacaagtgcattcacttcatataaaaataatatttaaaagtacattttactaaatatatgttctacattgctagacattcttataggttctatggattaagagataaaaggtccctgccttcacattgtccaaagatcaatggggaagataaacaaataaacagaacctggcaatactgtgtagtaagtaccatatcagaagatgttactgaatgcaatggaaaaacagaggagaaataattagcccagaataaatgtgtcaaggaaagcagtgtaagacagataataccaggctgagtctgcaaagtttagtggaagatagttgagaaaaagagaatggggtggaggtgtgtgttccaggctcagaaagcaatatgtacaacagcatgagaagtagaaagcagggcacaaaccaggaaacccagcaactgattatggctgtaatatagagtggggatgttggtgagggaattgcaagagctaaatctatgtagaagacattgtagaccttgaagggctttctgtgctgtcctgagagttttggattctattctgaaggcaatgaagatccattgaatactgtcaagcaaaaagctgacatgattagactagcattttagaaaagatcattctagcagatgagatgaatttgaattagaaggggttggacctgagatgaggaaatgaggaaggaggctttttcattaatcatggcaaaagctgtttaagggttgaactaacacagtagaagcgaagacggaataaaggaaatgtatacatgaaacacattaagctttttttttcccccagagtccctgtgtttgttgttctctttgatgggtccactcttacccaagatattttcatgtataactcatgctcatcattcaagttctacatcaaagtcaccttctcagagtccttcccttaccgtccctataatgtcaaccctttactgtccttcctgtagccactagtccattcgtaactctctctcctctatattgactaaaggacagccttttgcagcgtgtatcctcatctgaaataatattaggcatttgtcgattgttgtcttctttcgtttagtttgctggcatattatctagaatagttgccagcatagaaaaagtactcaaaaattcattctagaaattcagtaaagcgtatttattaaatggacagttaacagacacatcaaagtagaattctccaatattttacatacggaccaaggcttcaggatagaagcttgatctgaagatatttatttgtaagtcattatcccacagagaggatgaaaagctcgtgtatcagttaagatgccttaagcttcaactatgagaatacccaaataaaattagcacaaatgatagggattttatactattttgcagaagaataagttcagacagaggtagataggtacagggttggttaatttatctataataaagtcagggggtctaaatcaactactctgtgattgacagacagtttccaaagatagctgcctttaattccttccttccatctgtgtacatagttgctcacatgaacatgtgtagcctatttctctttcccttctatcataattgtttgtatttttgaaaacatagagaatgcatcattaatatttacacatgttactatatgtacactttgcctcgctgggaaaaaataaacaaatactgaattctagttagtgataagtatgttgaagtgtttagggggaagtatactcatatctgcagtttatttaaaatgtatcaataaaataagactaatggatgaggaacgattacatagctatgtggtaagacaagctaacaccacgttaatggtagaatctaagtggtggggaaatgaatgttcaatgtaggattctctcaactttactgtaggttttattttgttataataaaatgttggagaaaataactggcttaggtacccaaatgctcaattttgtaagacttctctgggtaaaatgtgttcccagtaaagccaccagcatcatcttttaacagtctgcatataacaatactgagcgtacactgagtgtctcttcagtgctgctctatcagtctggtatgtggtacataaaattctggaataaatggggcatagatcctggccttgagcggcttacagtttggcatatcattaataacaatgaaatgctagagtttctcttatagaagcatcgatagggcacgagggtaataaagaggtgacattgtaaccaaacgaatgaatttactttggggatgaggtttgacacacaaagaaaaattaaaccagatagggaagagaggaggaggtgagcaggaaggaaaagtcacgccagaggagtagcatatgagggaggatggtttgggtaactaaaatattgactgttgctagaacaaaagaagattaagatgagtgctgagggatgggatttgaagggtagagaatgaccaccttgttcaggactgatggacaaacagtggcatttgcatgtcaggaaaatgcagattgataaatgttgagaaagatcacatgtaaatgatcattagcttgccaattatgcagaacggcaaggcagattaactctttctttaataacagataaggaaaaaccttagatatgtgggaagaaaaaagaactaaaaagccaatgaattcttcccacacataaagtttatttccatgaatgttgagacatggcattggttgtgccagagacttaaggtatcatttggatgtaagtatggtgattcattcattcaccttcaggtagagaatcattgcttcaaagacgagaaatattagcctgagcaatattagcaaattgaggttgtatttccgaagtcctacaggttccagacctcccatctaaagaagagctatttgttgcagtaatctgaaattctgtcagatttgcagagttaagcaactggaagtttaaattgaatgaacattctggtaatggatagatgatcaattttaaataaatcagagaccaaatataaacacttaacactaagattgaagggaaatttgttcctcctccaatcattctagttatgaacatcaaggttcataatgaggcaaactgtgaaacccatgctttatttctgttttgtttttttggtggtgcaggtaccatagaaacactaaactaccagcaaagaggcttcaaatgcaaataaacacttgatagaatgccccataaactagggtttactgtatttggaaaacatgaataaaatcaccacaaataagttttatgttatggaatttaaatatctttttaatgtttctgagaaagaatgaggtaattttagatacatctgcccctccctgcctcaggcttttacttctttaatgcaaaaatagaaaacattctgaacaaatatatgaatggctgtgtttttctacatatttagaaggaaattgcttaatccatcaaggtattttccctaggaaaatcgcttggaagggattgtccatgtcttttgtttttgagagatgccagcatggttttgcaaattgacacatactttcccagttatctctggaaggacgttttgaccgctgctctttgagacctgcagtgactttccattctgcagagttcttcccctttccctaccgcacagcgctttttactctacttgtcggcttatgtccaaatataatctcaccagtgtggaaaggtttgactggtgttcctttcgaaatactcttcctattttcctccctgaggcattcttacccctccatcactgccatttcagtcacgaaattctatcactagagttaacttagggtgatctaccgctaattcccctttcccgctctccacctggagaattaaaaacctccattttgaaattaaacctccaattgaaaacaccaagaagaccaaagtggggggcattttacactctttataccattttatttgctatgatctggaatgtaatatccccccaagacatggaattgaggacgtgaccctcaatatccaatcagatatcaactttaaaatgtctacttaaaaattagaagttggtcctgaaattttttgcaaagtcagaaagtaagaaagtgaaaagaaaataaaagggataagagcttgtcaaaaggtgatagtacccaacttgaaagagttcccaatgaccaaaccaggaacaatcagagaaagaaaataaacactgaaattatttcaatataattcaaagtataaatcataacttgtgaatctatatggacaagaataaataatcgaataaataaatgaatgaggaataaagaaaaattgttccttaaagaagatttccaaggaagaaatgtgggaaatagaaaatcatcattagaacactagaacaataattgtttcaagcaagatcctctgatgaatgctaaaattagtaagcagaaatttaaggtgaaaaactttatgtagcttcaatgcatctcccacaaaatatgtattaattacaaagagaaaagtaatgccttcacagttgagcagtcttgaagataacaccttaaccaagtgatcactttgattacttactaataaaatatattaatatcatattaatataatatgcccctaatataatacacaaattaagcaaatcataataatggcacatcatccttgtgaaatttccccctaacatctgtaacttcaatttaatcatgaaaaaaaatcagacgaatccaaattgaagaatattttataaaatacttgaccattattccttaaacgtgtcaaggatatgaaggacagacaaggaaaagctgaggaacgaccacagattggagaagatgatggagacatgcagccaattacaacattgtattaattcattttcacactgctgataaagacatacctgagattgggcaatttataaagaaaaagagttttaatggactcacagttccacatggctgaggtggcctcacaatcatggtgtaaagtgaaagacacatcttacatggcagcagacaagagagaatttgtgcaaggaaactcttataaaaccgtcagatcttgtgagacttattcactatcacaaggacagcatgggaaagacctgcctccatgattcaagtacctcccactggattcctcccatggcatgtggtaattgtggaaactacaattcaagatgagatttgggtggggacatagccaaaccataacaaacataaaattctggattgcattttggattcaaataaaaacattagcagaaaaactggtaatatctgaataaagttcatcatttacctaatatataccaatgttgatttccctgttttgacaattgcaccatggctatgggagatattaacaacaggggaagctgagtgaagggaataccaaaaatctgtaatatctttgcacattttctaaaagtttggcattatttcaaaacaataagctttttttttaaaaaaatgtagggtattcctgagactagaatgctcttttaacattcaggtaacatggaggggttatattaagcttaaagttagccatatcagctaggtctttgtcacataaactaaaggtcctgactctatttttgtgcaattgaatttctgtgaacttaattgcaagagcttcaatttatcattattaaaaaatctctagtgggggaaggagggatgaataggtgaaaaatgctccattccccacctatttttagagcagtgaagctattctaatagtggcacatgacattatggatttgtcaaaacccatggtacacgcaataccaagagggaactctaaggtaaactatgaactttgggtggtaatgatgtgccagggtaggttcattcattgtaacaaatgtaccactctggtgggagtgtgaatggtggcagggtgggggggctgtgcatgtgtgggggcagggaatatacaggaaatctctgcacttttcactccgtttttctgtgactctaaaaccgatctttaaaaaaaaagtctagcaatataaaaaaattataatcattatagctttaactaactattttagccaaatgagctctttttaagtgctgagtctgttattcaacatatgtattactattcttaggaggaaaaattatgaaaattttaaattacacaactgaattttataatataaataaaatatatatcatttataatcatataatatatttatattatggtataactaccacattcatattttcaaacttggcactttcagggggttgtttttggaagacagggctaatgttcatcttgcaagccattacatctatgaagcacttagtgatttactgtgttttcacaaatactatgccgtttggcattcacagctgcaagcaaactgctgcaccatgcttttagaatacagaattatgacattgtaagagaagcatgatgggatctatggcataggatcatccaccaagtaactgtgttgattggagattgtgatggaccaccacatgcctctccagatcactcccttacgtttgctacccaggagagcctttagaagaaatgctgacagggagggaggagtttcacacttttgtttacacatagaaagggcagacccctaattattaaaacagtacacaaattggaggattggaaggggacttaatgtaggattgaatttcccaatcaagaagaaaataaaaagaatctcccttccaatattgtcaatgggcaggcactgagctttggaaagaacatttccactcatgggtagttctctgctctacaagggagtccagtcctttcttaacacgtttagccattgatccaaaatgtgatgtcctattaatagtacccattgttttcattttcctttctggagctctacagtatgtttaattcatattccatgttcagcctttaaagagatgaaagctgataatatttcttccctcgtttccgtatttttctttagtagattaaaaatctccagactcttcaactatacctgatgtgatatggtcttttaatctgtgctaatttaccctctccaaaattcccaaaagtatggaaaacttctggtcattttcactatgtaagccagcctgtaacagctcacctctgagcttttaaaaactttcagttttgaagtattctggattgcaatttgtacttactcttttatgctacaataaatgttaaaattttctttgctgatttgacttgattgttgacagtttctggtgtcagacgtgggagcccaaggagctccctgatgaccctcaatccctcaaaccctcaagaccctcaagatccataagcaggtgccaacacccagagagcctgttgtgcttactccttccttgccaaccacagagctcatctgatgaggccctcttggatctgagctcagctctcttggtgcttgacctctccacttgtaatatataaaagtgttattttcagtttgcttgggttagcttaggaaagtcacctttttctgttcaaagtgggaggatccatgtttccctggatgccagaacagtagctactctggatagacttcccattgcttatttagcattgcaagaaaacaaaaaggcagaatagcatcttcccagtccaaagcaccccaaaattctccatctaaaactctggctggttatgtggttaaaatctgtggactcagcaaggcacagtggcttgcgcctgtaatcccagcactttgggaggctgaggcgggtggatcacttgaggtcaggagttcgagaccagcctcaccaacatggtgaaaccccatctctactaaaaatacaaaaattagccaggcaagcaactgtaatcccagctacttgggaaggtgaggcaggagaattgcttgaatctgggaggtgaagtttacagtgagccaagatcatgccactgcactccagcctgagtgacagagtgagtctccatctccagaaaaaaaaaaaaaaaaagcctatggactaggctcttttacctttctagagaagtgagtgaactttactaaggataatctggaattgcaatggctactttggggaaactttaacttggataaaaagatagctcatcttaaagatgtccttgaaaagggggatataaaagctctcaaaaacaatggaatacttcttttattgggatggagaggattctaaaagacaaagtggttctaagatagcttcttcacaggattcttgcagcacgctaatgagaaattaaacccttaattcagatggatctgatggaactgacagaatcacaccttgccagaccctctgctcctttctaccctccattgcctgattaagccaaacctactaatcctcttgatcctgtcctcacctcccaaactcccccaacatcagatgccttctaaagtaggatattcaagtaagccagagatcccaccctcagaggaatgtagtctggtttggagctgagcttcaacccattataaaagattttccagagcccaaaaggaccaaactaaatttacaggaaaatttgaaattctccttggtgcctatgattctgcatcttctgatttatataaaattatccatacaatagcaaatccaggagatactcaaaatggcttcaaataataggttggagaaagtctaccaaagattttgagaaccctactaaagatacctgcagagacgaaacaaaaagaggcaaaaaattaatccaaccgcttcttgaagcagttctcaaaatttttcttgtgagaatagactgtgctataacacaatcttttaaacagaaaaggggtaaactggtggcagatttccagacttccacattagtttagaagagatattcagacaatgctctggcctcaaagatcctgggactggtattgctacatctgctcatttatttagctagctttgcccagaactctgtaatttaccagagaaacctaagtcagaatggaaaatcaccccctcccagagcttccctgtcttgctaaatatttcaaaaaaagcaatagagcagggaaaaagctatcaagcaaataaactcatggccttccaattataacaatcacagggaccttggttcaacttcaaaagatccacccccacttaaaattttacccctattgattgagatgtctacagaaactgtcaacaaaagagacactgggaaaaaaaaatccccttttaaatcatgggccgattaaacatcttagttgccctgtaagacagaatcatgaagctaatcagattcttgtgttgactgtcaatattgacaaagctccaaggaatcacctagttaatttcaataatttatttcaatcagtaaggagaaactaaacttgaagtaaatgggggaaatgtgtattgttttggtagatatcaaggcaactctacattaaatcctacaagaatacatcaaaatcttccacagagtaataaaaatatctcaatggtgggcatttcctgtcaagttcaaagagtttattgaaacccataactgtcacccttggcatcttcccttaaagttacacctttctcttatgtgatactacccctgtaaatttcctcagtagagaaagaaatttattttgatttcttacttgcttttcaaagtaagaggtcaaattaaattttctctaggaaaaataaccttagttacaccagattcatcagacattgaaatgttgtatgttcccgggtccgaattgattgtcctgaggagactgttaaagtccgtaaaaatataaatattatagatgtctctgaaatttctgttagctatggacctcttcttctacaaatatagaaaaaaaattaaaagtgccagacatattaaaatccagaatgatctttcaaaaccatgtcctaggtaaccttggtatcccttaagacttgaagaaatacaaggactcactcctataatagatgtaattacacagaacctttgtcctcagacagtgttttcagcatccagagatggacactcaaagcaaaggctgctgcacacctgacaacccctcccacccacactcctcatgtcaggtagagcccttcctcacaaggcaggttagagccccttgtcacagctcatcatctcactcttttgaatttaaataaaaaatgccagctccctatccccgacctctcccactgttccatgaccagttgaggttcacaggccttagtcagaacctggccccccgctgagaccccattctcaggcatcctgcaagagcccgtctcagctaggtttctgcatccctctggatcctactcggagttacaggcaggtgtatgggctggtgcaaggtggagacaggacctttagtggaggctttgtgagttaattttgagtgtatgaagctcacctcctcctccccagaggccggttacagctctcttcccactcttgccttctctgcttgtcacaggacaagggtctggcagattgcccaccagctaacgactggagacagctctgcaatgcactgggcttaaagtacagtaattgcttaagaaatactcgtggatggctgtctgcacagtgatcagaaacccattctttaagactatttttgacaacagaaatttcaaatgctttgttaatccaaaatttctactattctctaaaatagaaggaaatcaggagaagaaaaggagggagaaagcatgggttagtaatcagcacttgctgtttctgtttcttggtgttcgcggcagccactgtgtcacctggctggagtgtcactgaattgagtgcagtctggacgtgatggatcaggctctaaggtccactgtgtatcttcaacctgtcctcctggcccagcagacgggcctgtccctcccttctccctgtagttagcctctctgcacacatcccgtcacaccccggcccaaagggttcctcaaaaatgggtagccatgttgggtttaataagaaaatgtggaaaataagtgttggtaaagaggtggaaaattggagcccctgtccactgctagtgggaatataaaatggtgcagccattgcagaaaataatttggtggcaccgaaaaaggtccacgtaaaattatcatgagacccagccattctgcttcaaggtatacacccacaagaactgaaaactgagactcagatacttgtacagcaaggttcattgcagcattaaaaactgggactgaggtgcttgtacagcaaggttcattgcagcattaaaaactgggactcaggctcaggtactcgtatgccgaggttcattgcagcattaaaaactgggactcaggctcaggtactcatacaccaaggttcattgcagcattaaaatctgggactcaggtactcgtacgccaaggttcattgcagcattaaaaactgggactcaggtactcgtatgccaaggttctttgcagcattaaaacctgggactgaggtactcgtacgccaaggttcattgcagcattaaaagctgggactcaggtacttgtacgccaaggttcattgcagcattaaaagctgggactcaggtacttgtatgccaaggttcattgcagcattaaaagctgggactcaggtacttgtatgccaaggttcattgcagcattaaaagagtaattactatctaaatatacagaaactcccaattcagtaacaatttattcttacatttttctgtatcttcaaataatagatacagaaacaaaattaccacagatttcttgacccccagagcttctgattctaggatgaagtccaaagttttgcatttctaacaagttctcaggtgatgctgatgcttaaggcccaggtaccacacttttataaacaggctttcaataatgagaattcagaaatggcagcgtacagcatgctgggatttgaagggaatgtggagcaaatctgtgaactggataggatcaggtcataaaaccacacgattctaagtgctgggcatttactgttcttttccgtgctacatgctggtcagtcttccaaaccaaggcatcgctctcccataaaacacatccgaatggagagtgggggatcctggctcctccactgtttctcttggccgggaacaagctctgccctgggcttgccctgccctccctgggcttggtttgcacaggcagcttcccacacacaacttctctccacaggtgggctcatgcccagctaaaggttcagaagacagaaaccagtgggctactccccttaccttcaagactgtgaaagctaaggatcaaacctgactgagaaggccaaggcggccacatgctcactgtggtccctgtcccctgataaagcttgccgaatgcctggattccaagatgggaacagggcaatggacagaccgaagggcaagaccaaatgtgggctgtcgcctgctgccttttcactgtagtctcccctttggagtaaatattgaagatacagagcgaatgctatgtacaggagacaaagtcttcctcttcagggaaggaggagagcgaggggaggttggtaaccacccttacgctcaacacacacaggctcactcacgtgcacaacactcacgtgcacaactctcggagctcctgagggtgactgcctgttattacacattacatttgacgagcacattctcaatctgcgtcagttcaggatcatgtgaaagaaattatgtttttactctcatcaaaacaaaggaattaatttaaattactgtgtcccttctaaagatctggaaacaaccttgatttttttccccaggaagatacaaagagagaaacaataataatctgatttacacgtcaaagtattttttggggggatatcattgttactttgttttgttttaattaatctcttcaaaggaccgtggaggagaaatggtgaagcctgagttgagaactgaaaccgaaaaggcaccttttttcccctctctttgatatcataaagtatttacagctattaaaattaatttcttatgtattcatttaattatatgtattgagtgtctactatgtgctgaagctatgctaagaactatggttacaaaagtgaggaaaatcaagcctgcccgtgctatcagcttacagcctgattgtacaatgaccgtaaagtcaaactgaaggaaaatgtgaagcaaatttgagaactaaagatgatcagatgataaaacttcacaattctaagtactggccattcactgtcctttttcatgtggtatactgggctgttgtccaataccaaggtatcattctcccataaagcacacgtgttttgctctatgagaatgtattaaaagaagatttaaaaataaacaaataggcctggtgcggtggctcactcctgtaatcccagcactttgggaggccgaggccggcggatcacgaggtcaggagatcgagaccatcctggctaacatggtgaaaccccgtctctactaaaaatacaaaaaaaaaaaaatagctgggcatggtggcgggcgcctgtagtcccagctacttgggaggctgagtcaggagaatggtgcgaacccaggaggcagagctttcagtgagccgagatcgcgccactacactccagcctgggtgacagagggagactccgcctcaaaaaaaaataaaaataaaaataaaaaataaacaaataaaatatgtttataaaaaaggatttaaccttgacagaaattgcagaaaacacattcctgaggaaataagctggaaccctgaaggtgtgtgtttgtgtctgtgcaggtgtttgcatgagggtgtcacctgcatgggtatgtgtgctcatagaccatgagagtattgaaaggaacgccttagaaagagacagcagcatcggcaaagacccatcataaaggagaggatgcagattctgcacatgtgtcccagaatttaaagtaaaataaaaaataaataaaaaatattctggttaagtgtatctttctctatgtgtatatatagtttcatattttggtcaccagggaaccatatgcaaagtgatatgcatagatatatgtgagtttcacttaacacgtttctttatgaaactgaagactcctatatatatatatatgcaccattataaatcatacacagatagtgatatataaaatatagtaaaatgtgtttaataccaaaagtacaataaaaataatacaatgttttcttgctaaagcacttgaggatctatattttgagtccaccattatagatgtcaattttctttgcaggcccctctacatacgcgaggtttggaaatggaaataatgtattacataatagaaaatatctaaaacaccaaaataaactttactgttaggatgcggcatggctcaaaaaaagaaagaagaaaaggatgacctccagggactgaacaaggacagtattgagagtgtgcagagaatatgggcatgagataaccggagacggacctttcaatatgggtctccatgttcagtgtctttgttcttattttatatattgaaagaggaaagccactgcctttctgttcgttccttatcttctcagcctctaaaagctgacattagtagtagtggcataaagcagccattctcaaaagtgtggcataggaacccctggggttcctagagacattggtttatgagagtccatgatgtcaacattatttttataaaaatactataatgtcactatttttttctcattgtctcatgagtatacagttaaaagtttgtgaatacattttttgtttccccattgcaactaacctttaagaaattaccatctgtttcttattggtggaaaatcaaggaagaaggggccgggtgcggtggctcacgcctgtaatcccaacactttgggaggccaaggcggacagatcacgaggtcaggagatcgagaccatcctggctaacatggtgaaaacccgtttctattaaaaatacaaaattagccaggcatggtggtgcacacttgttagtcccagatactccagaggttgaggcaggagaattgcttgaacctgggaggcagagtttgcagtgagccaagatagcgccactgcactccagcctgggtgacagagcaagactccgtctcaaaaaaaaaaaaaaaaaatcaaggaagaatatctgcagttttcttaaaagcttattaaaataacatcctttctctaatttgatatctgtgtgaagccaagttttttttttttcatattcttcaaccaaaataaggtattgcaagagactgaatgcagaagcaggtgtgataatccaggtgtcttcccttgggccagatgttaaagatatttgaaaaaaaatacaaaacaatgccaatcctctcactattttcttttgaaaaacataatttgtttgtttttgtttctttgagatggtgtctcgctctgtggcccaggctggagtgcagtggggcaatctcagctcatgtaaaacaatgacgcacttatctagccacatgtaggttaagatagccaaagtcattttttaagtgagtgggcataataaacaccaagtttagaatggtggtgagctctgggcagggagggaggaaaaagcaagtagatcgaagtgagcaggatttgtgactttttaaaaatttttttattttttgagatggagtcttgctctgtcgcccaggctggagtgcagtggctcaatctcggctcactgcaaactccgtttcccaaattcaagtgattctactgcctcagcctccagagtagctgggattacaggcttgggccaccacatccggctaatttttgtatttttagtagagacagggtttcaccatattggccaggctggtctcgaactcctgatctcagatgatctttccgcctcggcctcccaaagtgctggaattacaggcatgagccactgcacctggccaaaaaatatagtttttaaataacgcaatttatttgtattaacatagaatgatattattatcattttaaatgacttaataaagaaatatttttaaatactcttaattttaattctaatgtgttaaatatcaatttgctataatccacataagaaaaagatctttgttgtcctcagtacattttaagagtataaagggctcacaaaaccaaaaagtttgagaaccatgatgtaaagagaaatgcaaagcaatgttgcttctctttggacctagatgaagtaagagccatctaatgttatataatatggggatgctttgaaagagtttccaccaaactgccttctggatggacttgttttgaacccacatctcttgatcatcaatgcactcactgagataagaatgacttcctttgttaagattcacatcccaccaggtcagtggcatattctcatccttcagtgtatatgactgcatagaacctacactaaaaggaaaattatctgtgagttcttctttacagcaagttagagagagattcaaatggtctgtccacaaggagagtgacagctgggggaatgaagggcaggaaggtaagcagaggtgagggttctcattagcctttatgccactcgatagcattgtctgcttagatagctcccagatcacacagtacactcattttaattcaaatttcacataaacaacatgtattttattttgtataaatatgtcccaaatcttgcatgggccatacttatactaaaatataattggctgtttttatgaaattcagtaataactgagtgtcttgtattttcattcactaaacctgctaaccctagctgcttaggaatagatactctgcagcttaagtgtttgcttcattcattgctttttaaaatatcatttctgttaagtgcttcataccttgtaagaagataaagaaaccagtttagtttttaagagactgagcaaaagacttctttgtactggaattggtggcatttgatgcatacttgcataagtatgtcatggatgaagaatttttgaattttttttattctagtagaatttgttgtcaggtgacttgtcccatatatttagttgctctgcccttaagtacatagatagcagtcttactttcttacttgtacatttgcttctctatctcttttattttttttgcaatgttttcacattccttcagttaaaattaagcaaatagaaagcactattttctaactcattcttttattcagttcaattcaatgattatggaataagcaccaactctctgccaagtgttctccaaggtgctggaaacagcagcattaacctaacataaaaactctcagagtggacataacattgcagtatggggagacagactctataaatatcatagaggtggtggtgtaaatagtactgagaaattaagtctggtaaagtgctaggtagtgccagggtgtaagtggatttgatattatagatatggcaattggggaaagtctcatttataagatgatatttcaataacaacctaatggaagtatggggatgagcaatgagaccatctcagggaatagcattgtaggtagagggacaagaaagtgtgaggggctcagataggaaagtgatttgtcagtttgagaaatggcaaggaggccagggtggctgaatcacgatgagaaagaaggagagtggtaggaaatgaagtcagttggtagtgaagagagggtacagtgtgggcagaatacatatagtctgataaaccataataaagacttgcaggtaggatgtggtggcttctacctgtaatcccagcactttgggaggctgaggcgggtggatcacctgatgttaggagatcaagaccagcctgaccaacatggtgaaaccccgtctttattaaaaatacaaatattagctgggcatggtggtaggcacctttaatctcagctactctggaggctgaggcaggagaattgtctgaacccaggaggtggaggttgcagtgagccgagatcgtgccattgcactgcagcctggatgacatagcaagactctgtctcaaaacagacaaacaaacaaacaaaaacacttgggcttttgctctcagccagataggaagctacctgtggttctgactcgtgtttatacaagttcattcgcagtgttataaagaagatgctgtgaggtactaagaaaggaaacaaggagagaatataaagggtggtttcaatatgagataataggagagaatgaaggtttaatctgggaaggaagcagtgatggaggagaagctgtctgactttggataatatttataatgtagaatcagaatttgctgctgcattggacataggctgtaagagaaagggaggagtaaaaaatgactctagcgtgtttgccctgaacagctagaaggatagagttgtcatttaccaagaggaacgtgaaataaggaatgagttgttctgttttgggaggggaggggggatcagctgttgaggtttatacataaattagagacgcccactagattgccaagtagagatgctggtgatgctgagagctcagttgggtaaacaagtcacaaatgacaggggcagatcaggattggagagaaccagaagcagcagctacagaaggagaaagaaaagaaaaggcgaagtaacgtgtacacagggacacagcgtgtggaatgacagacactggaggctcggaaggagccgggtgagagggagatggatgacgaaatattacttaatgggtacagtgttcattacttgggtgatgactatactaaaagctcaggcttcaccattattccatatattcatgtaacaaaattacacttatgccccttacatttatacaaataaaaagatagtaatctcagcttcaaacgaagggtttcaagaaagagacagtgatcacatgatgctttgtgatatgcagatgttggttaaaatgaggactagattaacccctgagtctgacaatagaaggcatgatgtctctggcaagagcagtgtcaggtgtgtggtggacaggttggggcaaattaaagggaaaatgaaagggaaaggagtgggaaccaagagcaggagacagatgtttcagggttcccctcttaaaggagaccacagaaatgggacagtagctagaaggtagtgtgggtgtcagaaggactttttcccttagcataggagactttagagcatgcttatatgctggtggaaatgatctaacatattaaataaatagatgatgcaggacagtaaaatgacaattcctgaagcaatatacttaggcacatgtctctaacaaatggaacaacctcgttatttggagatatggagttattcaatcttaggaaaattataaatttagataattggctagcgatgttttttagcaaaagggccaaattagccaattaagaatgtgtacaagctgcttttctccttcaaaatgaaaatagcatattgagctggaaatgaaaaatgcaggctttaataacttaatttaaatattttattgattaggaaaacatgaatgagaaaatgccttttttaaaacaattacattgctaatgtctgagtatctaagcacatggaagtatcattctaatattttataactttgaatgtaaatgcattttgagtgtttcagagcatggcaggtgtgtgctgggacaggcataggcataggaacttgctcacagaccatctaagatcaaaggccccagctgctgcaacctgaaatccatttttgaggtcatgcttcctggaggttgcttttggacaatgactgaacatgcagggatacagaggcaggcccattcctgggacacatggggctttgatgggtgtctccggtgagtatttcctcatggtctggccaaaccttccatcaactgcactgtggtctggaacgcgttccctcttcctttcttcctcttctcacctgggggcctgacttgcattgaggttgttgcctctcccagcttcttctagctccctccctattttatgtcatcggtgtttcctctaataaaatatttacaacattattcacatctgtgcatctgcctcttggaggattcagactaacgtaagtggtaccaggagtggcctaggaaggtaagacaggacttgggaggggcttcccccactgacagcaggtaaagagtgccatcgaggtttgtggatgggacatggatagccctggcacaagattgcagaccaagttctaaacatgtaattgatggtgaaccgggaaaatatcctggtggagagaaatgctgtggcaggtgcagggatgcaggcatttgaaaaatacggggatgagatggaagagtgcctgtaagacagaagagttggcaggatgctggtaagttgtactgacttgcagaaggataataagagactgaggctattaacaagaagttaatggctcagtgaaaatccagagaacctctgtggtcatttaccaagagaaggacaggcacaagtaaacagcagactggagattgtaggagtctctaaagctgtgaggcatagacagggcaggttgcttatggaaggttagaactctggtgggagaaatctggagtccagtaacctggggcagggctatctgggtggatgctggtgatgttgaccctgcaactgctcaaggatctgctgggcttgcagaggtggcccacagccccctaccaagtgccaaccctcctgctatgctgagagggctgcagaaactcctctcacttgagtcaatgggagtctcactcagcaagttccctgagtcctctgcaagctgccaagacaacagacaggtcaaatactagtacagcttagctggagacattctgtgcctgataagagaaaaatggactctgttcttacaggtttgcaaaatgtagtagtcatatgcccctaggattggatttgatgatggatgagcaaaaggaccagaatatatataatccctcaaatcaatgaattattatttatgcatatgtatggacataagtaatatatatgcatatatattcatatatatacatatatatgcataaataataattcactgatttgaaggtactttatcaggacacaggacttaacaaggaccccaagagatggggcaaattgatgctggggtggctcttagaagtctggagataatgatggctagctcttggggaagtagaaatgacacagctattgtggagttggcagagaaaggaacaaagagattgagggaggaggtcatgccaaaatgcatggctatgtgaaaccagaaggttcactggaagagtgtgttccaagagagggcttagatgactcagtgtcacccaaacccatcagggatgtgatgatgagaggggcacagcctcctcaggaaatttgttggtggctctcctttgcaggcaggccaggaatgaatgtagaagtggcaggcacagggctgggctccttgacattgatggggtgatggggtcctgaagtaatagtgtcccaggggtggtgcttaacactggaaggcaggaagcagaaaatactgcaatgaccagcaagactgatccactggagattgggggcttcccattccctccactctggactctgcaaggtgtaagtcttggtccccaaatggagcacagacttaccagcagccatagcaagagtcccattgaattgcaagtgatggctgcctctagggcatttggggctccttgtgcccagagaccagcagacaggaagtcaccacagtgatcataagtgaccctaactagtagaagtatgtgggactgtttttacaaaatgcagacagagagaaacagaagaggaacccaggtgacactttggctcctccccatatgtccttgtaccattgtgacaatggatggacatgggatgtgatcctggactgggaaggacaaaactatgaggtattagggaccctcaaaatgaaactttggattacaaaatccagacaaagaaagccaacaatatgggctgaggtgatatctgagggtgaggataattcatagactcaggaggccggggcaggaacgaagaatgtcatgtggccctgagatccactgcaactgaggttcctcccactcatctccttctgagtttctcaggaagaaaagcccacgggaaacagaggaactgtttctcaaagctgcacagagaagtaaatcagctcagtgcaagaggtggattgcggtggccatcagaacgcacctgccagacctccagctgcagggagtgtaactgacccgggacttaagttgcttgatctgagttccatgtggcatcatacagaggacacccctgtcccacaggctgctccaacccagtgactgactatggtaggtttactaaggctggaccattcctgggaggcacggggttcccccaatgatgactcagcccaaggactccccgagggccttgcacagtggtcctggacaacttgcaccaccctttctttcctctttccctcacctgtgatcaggcttgcattgaggtctgatggctccccgagggtcactcacaggagtttccactgtgaaaatccttgtgtgcttaatcttgtctcagcagcagtttctcagagggcccaaactcacacaggcagcactcgtttaactcagcgtgacttgcgctataaagtgaagaaaaggcagcttcagcaactcatccaggatcataaaaggacttagctacagagttggggctagtttgctctagtcatggcaacatgtactgcccaccatatcgtgccaagtacgatgccaggctgtgggaatgtagagattaactgtaattttccttcttctccaaaggagacgactctctcccggggttgtagcatggcttctctgtttagtatggccagaagggatgagccgtggagcgcaggttaagtctaatgccctcagatccagagaagaattagctactccagcattccgattgtgtgtgctatccttagttggacagaggttctgctcagtgcccagcagacccagccaggtctcagcgatgaatgcagcacccgcaggaactgcactcttggcaatttccagtggctgtgctgtcacagcacacagcagttcccacaagatccctctccttgcccatagccgggatggacacccttctctgtatgagccatgtcctgattaggattggaggctagtggaggacggtgcagcaacaatgtgagaagatgctgccatctgccttttaccacccttttatcttcctatcacacctgccatcctttggcatatctagggaagatccagctttctttaggcacaaagaaaattcaagggaatcagtactttgaacttgagtggtgctcagatctgtatatcaatgtgtgatgatggatggaatcttatctgcattcatacctatgaataggtctgcattcacacctatgaatagttctgcatgcatacctatgaatagttctgcatgcatacctatgaataggtctgcatgcatacctatgcattagttggagacaaattggtaacaatggcataattgcattatactagcagagaatagcaaaagcttaattaacaggaatgtccagaactctcagataacttgcatcagttatccaaggcatctgtaacgaaatactacagatgtagctaaaacaagataaatttatttttcaccagttcaagatcagggttggtctctcctgaggcccctctctttggcttaaagttgccatcttcttcttgtgtccttacatggccttttctctgtgtgtctgtgccctgatctcctcttcttataaggacaccagtcctattggattaggatcaaccctaattaaaatattttaacttagtaatctctctgaagaccctctctccaaatacagtcacattctgaagtattggaggttaggacttcaacattaaaattttgagggcacacagttctgtccatcatacctttttttgtcattgacttctaggagaaataagccaaatttatttgttttattttgtttttaagtgtacatcaaaaatttaatttttaaaaactgttacaatatatattattgtgtcaagacaaaataaactcagtatttcaccctacatggcttgcaaagtttctgtaacccacctgaacctgaaagaagattatggtggcatgtcctgcagatcagcttttgtgagcagtggacgaatgagcggcacacgctttcctgagtagagggcatcttgctatatctagggagtgtcccactatatcttgataaagagcagctccttgagaaacagccacttagggagtggggtggtgatatggtataggtctgtgtccccacccaaatctcaccttgaatttaataatccccacctgtcaagggcaggaccaggtggagataattgaatcatgggggatagtttctcccacgccattctcctgttagtgaatttcacgagattggatggttttataagggggttcccccttcattcgggactcattctctctcctgctgccccgtgaagagttgccttccatcatgattgtaagtctcctgaggtttccctagccatgtggaactgtgagtcaactgaacctcttttcttcaatcattacccactcttgagtctgtctttattagtggcgtgaaaaccgactaatacgggtggggagaggatgcagccccttccccacatgccctgcagctgccagatccccttctacacgttcttgttccatgtttgtgccatagtcacaaatgtcctaaacggcagccatcagtctccacccaactccatgtctataaaacgtggagggcatttgttgagttattaaatcaggaaaacatactttaaaaattcaaggtttttaacaacataagccgttttgttttttcacaaagtcagggccacatcatagcatttcaagtcttataataaatctgtgtcctgtgtttagtgctcagctatattctctagagaattagcccatctctaagccatagcagtaggatggtcatatgatttaggtaagaaaattaggccacattgtagaaagcagatttttctcaaggacaactaagatattggctctgaaactggctgaaagcaagcctggtacctgcttggtgatggtatcacaggtgtttgcatatgtccaaacccatcaagttttacgcattaaatatgtgcagttatttgcataccaattgtacctcaaaaacgccgctgaaaaagaaaatttaaaatatggttcgggaggacacacagaaaaacacacacagacaaacacacagttacacacagagacacaaacacagttacacagagacacacacacaggcacacacacctagcatattttgtataataatctgtttctaacacctttgcaaataaatcacaatataaatactttggaggcaccagaagatgtaggctgctgccaggtgactctgaaatcgaacgctgctccacctggatgatgagatggacttctttgagatgcttttctgggaagggttctcaaggtaggggggccctaggttggggggtttctccatggaaaactggctcccagttctggacttcctagctggtcctgactccttcatttaacctctgtcaggaaacagagacagcctatctggaaacgaagtttctacatggtgattttttttttttttttttttttttgagacggagtctcgttctgtcacccaggctagagtgcagcagcgtgatctcggctcactgcaagctccgcctcctgggttcacaccattctcctgcctcagcctcccaagtagctgggactacaggtgcccgccaccatgccccagctaatttttttgtatttttagtagagacggagtttcaccgtgttagccaggatggtcttgatctcctgacctcgtgatccgcctgcctcagcctcccgaagtgctgggattacaggcgtgagccaccgcaactggccctacatgctgatgcttttcaagtcttacctttgggaaagaaatggaaaccattttcattatgtcttggccaaggtacgaatacagtggtttggattttgtggttaaaaaaaaagtgaagacagaatcaaactggagaggaggaggaaagaaacaaaaaggaatggaaaaggatgtaacgtgtcttgcattttaaactgcagggacagccttagtcggtttccaaaattagaccccagtgactgcctgtggtttgatgacatttttttcaatctccatgggtcataagagttcaagaaggtttcgatacattaatgaatgtcacagaagactctaaagtccatagtggacatgggccagccccgtgaggctcggcccctggttttctatctttgactatagcactaaggacaacaataataataaaaaaagacacaatcaactttcttgtttttaaaaacttatgtaagaaatttcttctcatttgtgaagagacctttgaatgacattgttgacagctgatgtgatacctcgattcttatcttcttggtttaaaagaatttaaacaagagacacacagcaaaggaggtgtagcatagagtaatttagttcaaaagaaaaagaatattctgaaagttagatgcagaagagacaggatgtcttgaatgaggattcagggctggctgcctgtgaggatgagacagcagaggctggctctagggagactccctttacagaagtcttacctcattcttcctaagtgggtgggaaagggcattgccaggaagcatgttctgagtggtcttctgggtgcacatacacagtagctgtacacactttttcatatgtcacatgtctcatcagcatctttttttttttttttttgagatggagttttgctctaattgcccatgctagactgtaatggcacgatctggctctctgcaacctctgcctcccagattcaagcaattctcctgcctcagcctccgaagtagctgagattacaggcatgcaccaccacgtccagctaattttgtatttttggtagagactaggtttcaccatgttggccgggctggtctcgaactcctgacctcaggtgatccacccacccaaagtgctgggattacaggtgtgacactgcgcctggcctcattagcgtcttaaatctccaaacgggggtgtgttttttgctattataatgatcaaagggtctatttgaggacagataaaatcaaagtgcacctgctctccagagggggcagtccttactgaagatagcttcccttgaatgagctcaattacaatgcgaatgctgaggcttactgtgttaattgtagggtcaccacgattgctatgtcccgaaaacacggtcacttccctgatacctatcctgcttcaacatcagagagacttttgggagatgcttggcgtgtcccctctgccactgttcctctcgggctccctgggcttctcaggctccgtgagtttccgtgttcttccctaatgtccagaagcctcatgcagaacgtcacccacagctgtgcctccttggtaggattcggtttccagacaccttctcttcctaatgtcacattaaacctctgagaaacacacagaacaccactggctagatgcccaaactgggaatttcagcaaactaaaacttggatagcaaggagaatccacatggtcatccataattagaatactggggatgcaacaatgacaaggactagtttatcacacagcatttaccccacgccaggcacggggctgcggactgcgtatttaccatcctctaacccacagaagcctggctgaggtagggatcgtggttatttgtttttcaccgatggaggggactgagacataattcaataccgaagtgaatattctgtctcaatcatgtacttcaaacatgtttcaccagggagatatctcctcattagagagacctgaaagcgagctaaatgaagagattaaatgcatcttcctggaaggggaaggaaaagccctcctcttgtccctgatcagaagttctctgttagatggctgctgcaagctgtttaaatgattcacgtaagaattgccatgaatgatgtgaaattcaagtgcatgtattatctggggaaataacacttcaaaagagaccacaaaagactatttcattatgtgactgttggtatgcattttaggccttggccagagctagttctgaatacaatctttattcactcctgaatcataccccagaccccctgttcacacagcaacagctttggaaaagagcctgggacgccagaggatccaggggagagtacaaaggcaccatggatattctttcaaaacctgactcaggaatcccattccccctctcacccacccactcagcaaactgaagggagcttttcagatatttccactgcattcggatttctctcccctttcattagaattgagaaaatggaagccaaattgcaaagggatgcaggcatgtttgacgcaaaggcataatttaggtttcaaaataactttaagaaggtcacaggaaaagactttggttccagcaagggcaatctgagaattagtaagctctcacaaataatcactcaatttgcctagtttaagtatgattaagttaaatgacaagaaactaacaaatgccgctggggttctgcaattgccaggtgattcatatgagttagtaggacctaatagctggttgcaagtctatgtcagataaaaaaagaatgactttgcttttcatctagagcagtagtctacaaacatcattaatagtgtgctcccacagtaagaaatgcttgagcgtatagccttcattcatgtttgcacatgtgttgaaaaaaatgtatacgtatgttcctgtatgtgaaacagctggtgacataaattctgacgaatactctctgggcttgaatcccagttcagccacttatttgttgtaggccttggtggttcactaacctaatcatgctttagtttcctcatctataaaatgagaatgataactattagtacactaatagttgttatgagaattaaactacttaatacatataaatcactttgagcagtgcctggcatataatgggttctatagaatgttagcagttattgtagctgtattaatatataaaattgatatattataattaactatatataattatatatgatattataatcattaaatgtaatataatctatataatcataattaatatataacatagatgatatatgctaatatagtttcaatcattgctaacattctgtagcatttgttatatgccacttctccaagtgagatatatgtgtatattttatatatatataaaatatatgtatattttaagatattatatataaattctatattttatatataaaattctatattatatatatccatcccctctgtggtggaaaaggtttcatgtaatcaatctttcaccaggtgaatgactcaatggtcctcctggggaaacttggcatgtaataggtgcagtgttggtctctgccgttgacaagagtagacaagtcagccttcataaggggaagactatattgttgagctttgcataggcttcatccctgctactgtaaacattttatcaatgggcccattgggcaataagtatattatacatatgttttatatataaaatatatatattttactacatacaaaaacagaggttttgaaaggatgagataaacctatacataacttctgatatttttatctagcaccccaatggatggcttaagagcccattagggtgtatacattctagtctagatatcagggaccggcaatcattttctctaaagggtcggatagtaaatatttcagctttgcaggctataacagtctctgtagcaaatactcaattctagtattgtagtacaagagcagccatagacgatttcaaaatgaatgtgcttgggtgtgtgccaataaaactgtgtttataaaaaaacagataaagagtatatatacattcaggtgactttgcaaagaattaaggaagttgaatctagcagataatcccaaggattgactaagctcaattttcccactcatgtccccagcagtgcctggggaagagctcttctctggacttggcttcaaagttcaagcatcccttcaccacagcgctcgccttagaggctgctaagacagaaacccttgaccttgttctccatcagagcatcaaagagccatcattcggactcgaaaaataccagccttccttcatgtattctgtgacaatgattacttcctttccttgcactcctgtactcacttcacttatccaacagtaagactgttgggtttcggttagactagttagaaagtgagctgaggagcacattagttattaaaatgttaggaagcttaaaacaaaacaaaaaaacaaacaaaaaacagaaaaagagacagatctggcccttggatagtttgcccactcccaccctggaggaaagaatgagggcaaatgggtaagaattacagagagccggacccagctctccatgagaaagaacactccagcattgttagctgtctctcattagcaagcttcccagcactgggattatttaagcagaagctggagacttacccccatggataattctgcagcaattctgagttttgtaggtgaaactagacatactttacagatctttctaaatctaagatttaattattgttatcctaagtagtggtgaatgtaggtcatcatatttgttcttggaggtctggaagtgaaatataaaatcattactgtgtctgagaaagtaaagaagaaatcagagcatcaggaacaaagtataagattgagaaaagaaattcacaataaataaacgtaccatttcttaaaagatacattagagtgtttgcataagcaggtgatactagtaagtatatatggcttttcacgatattttctataaaatgaaataggaggtaattttaacctatagcaaaattctaacttataatcagatgttaaagttgcagttttcaatatcaatttgggatccatacatgatcccaaaattaattttgagttcagaattttcactgacagcagcaaaatgctgtaagtgtcttattgggtataataagtaaagtaagaaaatgtgctcccaatttcacaccttggtttccagtccatgcattctgtcttttgggaggagagaattatgtaagagtctcattcaaaagttacgctgaattctggaagacagaagcccatctttttaggatgttgtcttccgcatccttaactgagtcttcagcaagccattccacctgtcagctaggccagctgcttctggaggatagactaggtggcaagacaagttaatgccatgagctaagcccattattatacttctgctgtgaaatgggttcctggagcagaagcagtgctgtgcaaaatagcatcacagtggtgagcacttacgggagcccaaagttgatggtcctggcaaagcattccaggaaggagaggccgacctatatcacagtatatgtctagtgcagtgagtacaagtatccatcccctctgtggtggaagaggttccatgtaatcgatctttcaccaggtgactgactcaatggtcctcctggggaaagttggcctgtaagaggtgcagtgttggtctctgccgttgacaagagtagacaggtcagccttcataaggggaagactatgttgttgagctttgcataggctccatccctgctactgtaaatattttatcaatgggtccattgggcaagaagtggggttgctggagagagaggctgactgatgtttacagagtgtctcattttgtatacctgattatgaagagcctccccctctgcggtccatgcctgtgagtgaacattcacatgcctcgccagcatcttcatggcctgtgcctgttcttaaagcttattctatattcctctctcccagccttccttttcactaaccttccaagtcccatctcttccaaatccctgactgtcaagtcaaaccagcatcagtcacccatgcatctgtgtagatctctacttctggccctctgtcatggcaaagataaaagtggacaatctgacacatgaagttcttccccttggggggattgttttcctcaccattgtcattcaggtttgcccctgagggccctgtaatggggcagctgtctaggttcaggtgacatcagcacgtaatgcaggcctgtctgtaagctaggctgggttttttgccctagatcaataggcgataaaggatgccacaggagggcttggccatgactgaagggaagtcagcaatgctgaaggagctggtgctagaggaatctaaaactcttgctcaggtaatgtatttatctatgctgggtctgtccaagtcagctcttattcaccattcccccttgataagggattactgctgtgcatacccaaccttggcttatgggtcacatagcaccaattggtgatgggaaatttaggcttaatgtcccacagttaggcattcagtctctatccatggccctgagaatgtctgtcttaagaaggatatatatttccagaagtgggaacagatttcatcctaaccctggaggttctccctgtgactctcctattggtgcttgccagtaacaccatacaacatccctatgttccacagacacctcagggaaacaccagatcatgagcccatgtgagggagcagctcacactgcagcctgggcatatgacagagacttcactcactctcctcaccaggcaaaactagcagatttataggagactgtgcaaataggcctaagtaacacactcaactgtgaaaaatactgcctttaaaataaaagaggtctgcaaagagccatgtttttgttcttctctggtgataggtgcaaggaggagcagcaactggtctttctacttagaggtcattgagacctcagaaacatcaccgaggtggcaggcccctggtttgatatgggacgtatcacccgtgctccaggtcaaatatgtcatatggaagtacacgctgctcatcagatctgagctggctaatttgtggactagtgtgatgtttcgtgaaatgtaaagtcaattaagattttagaaactgcatgtcaccagaaagcaggataattggtactgccctaagcaagattgtgaagttgtattattggccctgacagatgaaagcaaactgcttctggtttgtccttctaaaataatatgaaggaaagaaaacattctgcattctgaatgccaggcactgtgttgacttccttcaggaaagatgctacctctgaaacagcacctggaattggaatcaccacctaattgtgtttatgataatctgcagaaactccccatgattcatccaactgctgtacaggctgaacaggtgagttaaatggaggtgtgatagggatcaccacactgcatctttgatggtaacactcaacccagcaatcccccctgcaggaattgcttctggtgtactagcttggtagggaaagaaaattccagtgtcttctacttagtgtttcctataatgggcctcacccttttggctagagaactaatgtggagactctgacagttgccagatatgtctgtcccagttacatgttcaggaactggggaaataaccatacgtgtgtgtgtggattatctgggcccactgcaggttgaatttcagctaatcctccatctctcacctgaccaccataagtaccactctgactggtgaaccactgtagttattcagaattctgccaaccatgcggaagctcaaaatgctgctctcataaacagcttgcaagctggaggaccacctcctatcaatattttacttgctgtctttcaaactgacattagcaagactctagcatataaagcaacagcaggatagaacaaccaaaagggatcttagtccttcacatattaccctttaatttttttcgaaaaaaaaaatggatacttccttttggctcttcaagtcacctcttggtacaaaaaaaaaaaaaaaaaaacaaccctctttctttgagtcttaattttgtagtttaggacgggggaaaaagaatagatcgatttacctgaaaataaatgtcctttggcatcctgtcccacctataatcctatcttttgcagatatagaagcaaaaattgctgttagtgttccaccagaggtctgttgagaggtcatgatggtttcccgagaccggccagtacatcacggggtatgttctcatcaggccgtgagcttgatggtcccttctgcacaacaggctgtgaatgccattccggtttccacaggtaattctaaatgaagacccaaggcttcaacagtgacatttcaatttgtcctctcttgtccacctttctctcaataggtgtctgagatgtgcatatattcatatattctatggcagccttcccatttctcacttttcctaatagagaaaacatttcctttcttcacagcttcaactcaaagctctccctccctgggtaccacctagacaggcccacacactctctccttggcgtcagctttggctctcttgccttctgtcagcatttggcccttggaggaagggaaccagtgcttgtctccaaagatgtaaccatgacaacaagattgtggggtttatctctccagctcctcataaaggctttcctaatttctctggatcttgacatctaggagttgtcccatttggtctgaggaatttttaggctgtctcaatggtacatgaagagtgcccttcatgatacagtggcattttctgaactacaaatactgggtaccattcaagccacatatatcttctcttctccaacctccacctcaaatataactatcaagaaatacagtgcttaattcctttgcagtttttagatgttgcacaggctgtgagcattgactaggtaaattgttccccttctgattataaacttttatgttgttgagacaaagtaaaaagacaacaccgatgtcctttggtaaatattaaccaccaaaattccatttcacctgccattgaaagcattatttgcaatttatgaatggccaaatgtctgccagacattcattattttttgtctgcccagtaatatttcagagaatgtgtttcaatctttgatttcctgatgaggaaattgaggtttaggatattaagtgagttctccaaggttacacgtctggtcaagggcagagctgcaatttttactattatggcctaaaagctctctcttattaaatcagcaattctgggagaaggaagaaacagccaacaagaagggcagaagtgaggtaggcagaggaaatctatttgctaggatgtgggagtaaacgcatcgtgttgagatgtgaaaaaatgttcttctttcttcatctaaccttgctgtgaattgctgagcacaatgtctccctgtagtaaacaaatggtgatgcccaagattgactgtctgatttaactctcacaactgtttctgtccccatttttaccatgaagtaaacagttttaaagagattaagtaatgttcccaaactggtaacacttctctatcatgaagacaggattagaaactgctgctataacataggcaacctcaatgcgtctcaactgcttattcatgtccatatccagtggatcaagtagtgtctcacgctgacatctgctggcaccaaccacaaactggcttcctgtttagagatgtcagtctcactatggtgccgcataagtctgtgttgactgtgcaatggccttgctgactttccttgtggtctctgctaccctgcctttgaccttcatcttcttatgacttgtttgcctactccttctgccacacccaccaggccagccctcccaaatccacttaattattgtcccaccacttaccatctgcacgtatggtccttcactctctcttgcgtatctcctgtcatctcctgggttcctccagtggctgcagtacccccaggtctgccgtctcacagcagctgtgtggagcctctcaattacacaacccaattacacagcccagcagtgctttcccaggcccgcaggctggcccatgtgggtttcaacactttttccagcattagaattcatgatcccagatcaaacacatttatatcttgcaggtttattttgtttcagtttttggaaagtaatcatcatggaccatttttcggtagtggttattgcccattgtatctatgtggcatcatttcctgccccgccatctgggtgaggcaagcacagagaacagatatgacaaagagtcagagctaggagaaaatttagatgaattttttcaagttcctatttttatagatgagaaaatacaaatgacttgtccaaatgcatgcaactgatttttaggaagcttaacttgaaccttgatagcctgcattttggtctggcatgaagtctggtaccatttattgatcagtctttggagaaaaaatgaattctagaagcttcatttcaataactagtgtgatttcatgaagaacgggttatgcttcaccagcttgttaagaattctttgaattttactgtcacttaatgcaactgcaatgaaattgtacataatacagcagcagggcattcgtactgttttgtaacaaagtttcttggtgtcaaattaaactttattcaaagggcaaaggaatgcagtattagccaaatgcaagaaagtcaagtaatcctgtaaacaagcatggagttatagaacctagaagcagacattcctggttctggaaaagatattcaaagtcttattcccagcccccacattttacagttacgtgtcttcaggattcacacccaggactagaaaaggcgcctactccaagggctctttcgatccaagggttttttgtttcgttttgttttctttaaacacatttctcataggctcagcagaagtctttgtacaggatgtcctaccgtcatcgttaatattaaagaggtgaataatgatactgagagcaagcttttttgggtcagtaaattatactaaacagtgtaacttcagcaaacaatgatagcaagactagaaagggacctggtagcatcactccagggtagcagaagtgattaagtatcgataggagggaacaacttcctactgaacaaagaacaaaaataaaatgcaaaggaatccacaaatgtcttgtggtttacccagaaaaaaaaatacttgatcaaaatctcttattttacagatgaaggcaggggcctcagctggctgtgattcacccaagttctcatggctattataaagtattgctgagcaggtggcaattttagatttgacagagatacagataaatagactcagaaatggacttttctgacaatcacctgcttctcaagggctaggcttgtgtaactagctctaataaatcccaggctgctatctcatgggaatctgtcattataccacccaactggcttgtctttacccagctctcaatcccccaatacctgctcccccatgttttaaacagccagtactaacagtgttagtctttctataacgtcagaaagatctctccagtgagaagcacaagatattatttcttctgaaaccagcccagcgctctttgtaccatgacaaacgctcttctgccatatgcctcttcatacctgcattagtatgccagggctgacatgagaaatgaccacatactgagtggctgaaaacaacaggatttttttttgtctcaaagtcctgaaggctagaagtatgaaatcaaggtcttggcagggccttgctctctgtgaagcatgtaagggagcatctgtttttgcctcttccagctcctggtgctgccggcaatccatggtgtttctcggcttgtagatgcgtcactccaattttgcgtctatcatcacatgaaactccatgagtcgacctcctcttcttataaggataccagtcatattggattaagggctcgtcttactctaagatgatctgatcttaatgcagtcaccctatttctaaatgaggtggcattctaagacactggcgattagttaggactttgtgtatatgttgggggacacgattcaacccatagcaatgccccaagtctttggggactccttcacccgtagctgggtctggctatgctgaactgctccttctccatgcatccgtgtcttcttaagatatttagcttaccaatcccattaaaaaagtgggcaaaggatatgaacagacacttctcaaaagaacacatttatgcggcccacaaacacatgagggaaaagctcagcatcactgatcattagagaaatgcacatcaaaaccacaatgagataccatctcacgccagtcagaatggcgattattaaaaagtcaagaaacaacagatgctggcaaaattgtggagaaacagtaacacttttacactgttggtgggaatgtaaattagttcaaccattgtggaagagagtgtggacattcatgaaagacctagaacagaaataccatttgacccagtcatcccattactggttatatacccaaaggaatataaatcattctattataaagatacattcatgtgtatgttcattacagcactattcacaatagcaaagacatggaataaacccaaacgcccatcaatgatagactggataaagaaaatgtggtacatacacaccatggaatactatgcagccataaaaaggaatgcgatcatgtcctttacagggacatggatggagctggaagccattctcctcagcaaactactgcaggaacagaaaaccaaacaccacatgttctcacttatacgtgggggctggacaatgagaacacatggacacagggaggagaacaacacacactggggcctgtcagggggtcaggttgcaggagaacatcaggataaatagctaatgcatgctgggcttaatacctaggtgatgggttggtaggtgcagcaaaccaccatggcacacatttacctatgtaacaaacctgcacgtcctgcacaggtatcccggaatttaaattgaattaaattaaatttttaaaaaatatgttcagtttactgtctcatctcatctaacagtttttgttgttattgttgctgctgttgttattgttgtttgagacagggtgtagctctgtctcccaggctggagtgcagtggtgcaatctcggctcactgcaacctccgcctcccaagttcaagcgattctcctgccttagcctcccaagtagctgggattacaggtgtgcgataccatgcctggctaatttttgcatttttagtagagatggggttttgccatgttggcctggctgatcttgaactcctgacctcaggtgatccgcctgcctccgccttccaaagtgctaggattacaggcatgagccaccgcacccagtcaacagtttttaatgatcctttagtcataacccttttgacttgaaaaattagtatagtccagaaccttttgggttgaaaaactggtatattccagaagtatcttttctacagggcagcacagagaagggtccaggtagttttaatagataaacttatgcaaatttgtagcacatgaagctattgctctttccagaaatatgttcaagtctcctgaagttccattaaagaggcaacagctatggagctgcagttatccttgcttattggttccttctcactgttcaggacatctgccccctgactcctttcatttcagctccccacagcacagcttacattcataggccgggtactgtgtgccaggaactgtggtaagggatggaaattgaaagataatttcaactccaccataactctcagggagctcacaatctagaagaaaagttacctaactatatgcaatgtgatacagttataataccacgggcatagcgtttacaaaggaagtactagaggacccagggtattgaaggattgattgtgcattcagagataagaaagaaaaagtggacaaaggccattttatttggatcttaaagagtagacaggaggagtgagaggaggaacattcagtttcagtcatgagggcatagccagtgtctgatctactctttttccataaatgattatgaaagctggattaaatatgtaaaacagctgttttcaggacttggtcaacacccaacagagggctacaattcttgagagaaagcaagcacaagaaataagccccatattgactccagcttccaggtgcaggagaacagtgcccaaagaggaaagggcagatcaccaggtaggagaaccatcagtgttcaatgctgctaagagggctgaacttggcaggcaggtgattggcaaggagggaactgcagagggaatcccaaacacctgcaaacatattccctgagatccttggtgattctcaagctacgaattcacaagaagactcagaaagaatagcaaagaacaattgcatagaacctaagaggtgagcagagatgagacatcccaatgttggggagaagttggaatctgtaactagccagagactagagacactggtggattatttgattgtgaccctagaaatgtcaatccttaaggaaaggtgtaaaactaagctgaacacattttttaaagccaaaaaccaagcctctataggataaaagttatatgcttttaagtattttaactgccttccaaaataaaattcaatactcttcagaggaaaataacttcatacagaccctccacaaaatagaatccaccatctacagctaccaataaaaaattactgggtatgaaaattagcagaaaaaaaaggtggcttataataaagagataatagagttacttaaatagaccaagatttgatagtttgtatagattttattggcctgactttgattctctcatcttttcttctgatgttaaacccgtccaattaatttgtcttttcagatattttttactattcaattttagattttacatttggtagtttcctttatcttgtttttttgtgtgtgtgtcttgctgaaatgtgccatctttttgccttaattgatcgtcttacattaaatttttcaacatattaatatttaaaataattgttacaagtccttgtctgctaattccaaaacttgggccatcgccgcttctattgccatatatgttcttttgatcatgggtcacattttttggcttcttcatattgcacacatatttttattgcatgcaggatattgtgcaaaaaaaaaaaaaaaaaagaacagcagaaattgaagtgcagaatattttcccctagtaaaagctcactttttcctctgttagacaattagactaaggctctgttttctccaagctagtgactagttgatgtgggttgggtctgggtagtctttaatgacttccaccacaagtgggttcagacgtagactctttttcttccttgagcacttctgtacctacactcctcatgatcatgcgatcacccaggccccagcttcctgctctacaacttattcagcaaaaacttgtggtgtcaaattgtcaagtcatagacacttttctgtatttggagctccctcccatgtagagaatgaggcttctttcttctttttccagcaacagtccactgcctaattaatgctcctccatggctgcgcttccaggattggcaaatgcccacagggatgaaagtggttcctagggccttcctaggaaggctttgttcctgtctggaagttaggatttttctgtttctctgcatccagtgctctttacataaaatttgcgaacttacttatgttttctttcttttcttttctttttttttttttttttgagaccgagttttcttctgtcacccaggctggaatgcagtggcacgatctctgcttactgcaacatccacctcccaggttcaagtaactctcctgcctcagcctcttgagtagctggcattacagctgtgtgccaccatgccggctaattcttgtatttttagtagagatggggtttcaccatgttggacaggccacttgagatcactcctgacctcaagtgatctgcctgcctcggcctcccaacgtgctgggattataggtatgagccaccgtgcccagcctgttttcttgatgttatagcaagacctgtgatcttctatgattttccacatcctcattagatagtaagacttacctggtagtgtattaacttaagaatattgagattctcaaattcttcttcaattttctccaataaatagaatggctatatatggaagattagctaaaattgtatactcagaaattttacccctctgcctatacatatgtgtgtacatatttatctagtatgtttgtgtgcatgtgaattgtgattgaaagcatgattagaacatataagcttttcccagcctcatccacctctagtcccctctgctgcttgccttaccaattagcattgagccaccattatatcatggctcatgaggaagtcaaaccccattcacttcctactcatcttcttctagtagtttctcctagtgcaggttagaagactagaaaacctgcttttttctatctccctggaggtaagcaggaaggtcctgatgggcccatacagttttgctgcatgagattaacccacaaaatgcccagaaattcaaaacatagttacggatttgctgagtagctgctgaaatggtgaggttatgcaacctggaaacatggagctgttaacttgttgggattcactcaggatggtggcggaaatattaaagggaaatattagggcaagttatagggaatagtcatgaaccttttggaaggccgaaaggttacatagcttgtaataattgaacaggctaaaggcagccagttcttaccttagagtattaggtcacagggtaagtacgaaggacaatagaggcttccccagttaagtctgtttaccctgcctccattaactaatctttgagccagatgaacctcttacagggaggtcgactagggatattgccccctaatggtatttaccttagacctcggtacctgagctttaatcattcctagaactactctctgaaccatgttaattatccacaagtgtgtttactcaaagcttctgttgttaattgtataccaaataaatgcctggagtgcgagctgctcagggccagtgcagtgacaaacctctcttggtgtgcaggtggtcggacactcagctggactggcaaagcagaatatctgtgtgtcagtgtacattttattcatccttcatttgggtcagggtctgcaggcagcccccccacagctaatgtcctcttgtgaggagcaatacctcattaattcatgtggagaaaagcttcaatcaatggcagggagaaagtagacacataccttcaccttccttttgatggactttccaaagcatggttctgcataaactctgttagcagatatggctgactgctgagggggtccacctgtagaacaactgacagtatctctttatggaattgtcatgaagctgtgataagcatggtatttgtattagtctgttttcacactgctgataaagacatacctgagactgggcaatttacaaaagaaagaggtttaatggacttacagttccacatggctgggtaggcctcataatcatggtggaaggcaaggaggagcaagtcacatattatatggatggcagcaggcaaagagtgagcttgtgcagggaaactccccttataaaaccatcagatctcatgagactaatttactatcatgagaacagcacggcaaagacctgcccccatgattcaattacctcccactgggcccctcccacaacacgtgggaattcaagatgagatttgggtgggagcacagccaaaccatatcagtactgcattacttgcattgctttccatcatttcttcacagcctccattttctctcactcttagattgctccttcgaaacaaaactttgctggttaattttttttgtctgggtctgatctctgggaaagctgagttaagacaatctgaatcatgcatctcaaactcatgcaatgggaggaaagggagtacaaacaaattgaattactcttgatattagtagaaaatatctgtgtttataagtaaagtacagtttgcttgcctagagttgtttcaaccttttcatatggaaagagcacctcccatccctaggagaataagaaaccattccacttacaatctctacacttttaaggttctgaatgataacggtatctgaatatccaaacatgacatttcatcagaaagtagaatttgctttttttttacttattatttttattttctgatccactgactttctgaatatcaaccaccattcatcaacaagtaggtgaagatatcccaacaacagattcccaaggaaaggctttgaatcaagaaactgccattaaatagctgtatggctgcacaatttaagtaacctttctgaacctcaactttctcatcagataaaataaagactaaatgagatgagcatgggcacgcacctcactctgagccgggcacttactaggcacacagcaatgttcatctaatctgaaactttgtgttatttcaaacaaattactttgcttgatattgcttttagaagaatgtcctattccacctccggatgctaattgccttttcagattatgtatctcattaagctgtgtatatcttcatgttttagattcagtagtaattgagtgctcagtcattgctatattcactatcctgacaacatttattaaaatgaagcaattaactattgtcttaaatggagtttagaggtaaggctcattagacttaggctcattacaattaacttaagtgttaaatgcaaaattattttatcccaactttaccctgaaaatgtattcaaatggatttctctagagctggcattccttcgtcacataagcgcaaaactagttagaaatatttcagtgaaacacaatcttcattaaaaagatattattaaaaatgtaaagccccaaatttgctcacaggggttcctgctctgttaacatctgaacccaggcacaccttgcttcacgggctgccacataattggactcagaggctcactaaagttgaggtaaagaaggaagcaggcctggttttaaatggctcaatcctttatttgtattcagtttcacaggagatgagccccctttgcctacacaatggtaagaatgacaatgcagaagagaggctcctcttcctatggatttgcttcaaggaggtcagggctgtcagtggtaagtgattttctactgggttcatcagttattgtacaaaagtgtggctttcctagctctcttgccagactacagacattagacagaaggtttagaaattttattttatttttccaacagttttgtgaaaagaaaatagaagcaaagaagaatcctgtctagctgcatccaaaccccttttcccaacataatgcaacagatacgaattttgtggaaagcaccatttaaggggctgtgccaaggggtggcgtgggagtcaggcaggactgtgtttcactcctggttgcaccagtgattacctgtgggatcttccagacatatatagcctcacaaaatctcattttgtgatttaaaaaataaaatcatgccttttttttttttttttttttttgagatggagtcttactctgtcacccaggctggagtgcagtggtgcaatctcagctcactgcaacctccgtctcccgggttcaagcaattctcccacctcagcctcccgagtagctgggactacaggtgcccaccaccacgctgggctaatttttgtatttttagtggagatgggttgtcaccatgttggccaggctggtctcaaactcctgacctcaagcgatccacccaccttggcttcccaaggtgctgggattacaggtgtgagccactccacctggcctgcttattctttccaagtgtggaaataggagagataatattgaaacccttaacacaatcttagtcacatcatgcacgatggataaatgttccttttacccttggcttctgtgggttcatcagccatatggtataatttggaaggtaaaacatggatatcaaaccctatactagaatgtctggcatatgtcagtagcacctagaatattttgtttgcctctctcatgtggataattaagtgttccagttttcaatacagagtataaggcctcttcagcataatctctccaataattaaatggcaacttgaaatatgtaataaaagagttttctaaattactatgatttgattttgacctaaaggaagtaatgtaagaaaaaagaaaaaacattttaaccacaaagctgaacatgaaacaggctgcggaggcagctttttgtgggcgtgggaaatgagcatgggggaagtgaaatgtatcaggtcataggtactattctacctattacagcacccaagagaatttaaaatgtatattgacacaaaaaacctgtacaactcttcatagcagagttatccatagtagcaaataggtggaaacagtctatgtctgtattagtccgggttctctagagggacaggactaataggataaatgtatatatgaaatggagtttattaaggagaattgactcatacgatcacaaggtgaagtgtcacgataggccgtctgcaaggtgaggagcaaggaagccagtggtggatcagtctgagtcccaaaacctcaaaagtagggaagccgacagtgcagccttcagtctgtggccaaaggcccgacagcccctggcaaaccctggtgtaagtccaagagtccaaaagctgaagaacttggagtctgacctttgaggacaggaagcatccagcacaggagacagatgaaggccagaagactcagcaagtccagtccttccaacttctgtctgctttattctggccacactggcagtgattagatggtgcccacctagactgagggttggtctgcttctcccagtccattgactcaaatgctgatctcctttggcaacaccctcacagacacaccaggatcaatattttgcatccttcaatccaatcaagttgacactcaatattaaccaacacaatgtctgtcagctgacagagggatactcattagttatttttcctgatcctctcactcctcccaccctccaccctctgatggaacccagtttgtgttgttcaacccaggaacaatactttgcatccttcaatccaatcaagttaacactcaatattaagtaagtaaatattgagtatttaaataaaagaagccagtcaaaaaaggccatatgttgtacaattttatttctatgcactgtttaggccactgaactgataggggaaagatattagtggtagccaagtattgaggggaaggagatcctggatagtgactactactgaatatggggttttattggagggggaatgaaaatgtcctgaaattagtgatgatggttgcatgactctgaatatactaaaaaccactaaattatacactttatgttatgtagattgtatctgttatttaagaaaatatggcccgggtgcagtgactcacgcctgtaatcccagcactttgggaggccaaggcgggtggatcacctaaggtcgggagttcaagaccagcctgactaacatggagaaaccctgtctctactaaaaaaaaaaaaaaaaaaaaaaaaaaagttatctgggcgtggtggcacatgcctgtaatgccagctactctggagactgaagcaggcgaatcgcttgaatccaggaggcagaggttgtggtgagccaagaatgcgccattgcaccattgcactctagcctgggcaacaagagtgaaactccatctcaaaaaaaaaaaaatatgaaaactttgagagaacttgcagactaaattctgattgaataccccagacaacacattctcagagaaccactgaaaatgctcattaaagattcatttttcatcagtctattgagatttgtcatttgtagtttgtttcttgagtcaaggagagaccatgttgcagaattcaagaacatatattttttaagtcaagcaagcctcagttcaaattccagctcagctcttactaaccaagtacctctgggcaagttattttgcatttgcagtctgtttcctcattctaatgtgaaaataactgtaaaaagaaaagaaaaaaaaaacctccttcatgaaggtgttgtgaggattaagtaaaaacatatttggaacatatgctctcattagggatgacactgtactgcccccaacagggtgaaaattggctcttggagggggcaaaaatttctgttattatgtgttttgtccctccaaaactagccccactgacaaagtcttattccttagtatttaatgtgatgaagttggagaaacaattaggaaaaaattatctaaaaagactccttagggaggcgattttttaaaaaaggttgtagcgcttctttcctcattagttgattggctcaatagaaacccttaaaatcactatttttcatcacagcggtgttttcttctttgttcttaagttgaaacaaatctctgtccaaagttactagctgctggcctgtttgaggaataaagagcattctgccagcaacccaaatcctgtatttccagcaaagtgacatttgactcaaaaaggggtcaaagcaacaaagaaagcaaatccatataatttgtatggctcttctaattttctatcaggtccgtgagccctctggtttcttcagctgaaaggttcactgtgccacgtctgtggcccctaaactgccctgccccagcttgaactggcccaggtaagtgactgctgagggagatactattcagcctgattgcaacatggagcctggacctgaagcagaagcaggtgtgcttgtgacatgagaggggggcacggaagtgctaaatagagaagggcggggtccctggcgagagctccacctggggcctgggcccgcagacctaagtgaggccaggcactcctgtttccacacccaaatattgcatcttccaagaccactccggcctgccatgtccccatcctgtgcctatagaaatcccgagatcctagcgggcacacacacacaggcgctggacgttgagaggagcagaggagtggaagagcacaccgacaggcaccagcagactctggcaggtcatcgatggcaggagggcatggaattcagccaggggcggttagaggagtgtccagccactaggcggcccaactccagggaagacccctttccaacaccatcccccttctggcctccccatgtacccttgcgagctacctccgctcaataagaccttgcactcattctccaagcccacatgtgatctgatttttccggtacactagggcaagaacctgggatacagaaagccctctgtccttgcgattaggcagagggtctaattgagctgatgaacgcaagccacctgcagacggctaagctgaaagagcacacatgcccactggggcttcgggagctgtaaacactcaatcctagacgctgccatggggttccagcccaaagactctccccatgacctgcccgtctgtatgcttcccctacagatttgagcagctgggcaccaaagaagggagccacacctcctatggtatgccctatgagtggaataagggaaaactcctcccgtttcacttagtgccctaatttcccttcctgctgcctctgtccatattcagggtcttcagggcactagctctttcccaccagtctcccaattagcctttattcctagctcagcaaagtttatgcttaggatggtaaattctaaggatggaatacatgcatcaaacactaagaaagtgaagcctgttggcagggattggattcttatctagttaagtattcacttgtgtaaatccaaacctcatggacattttcagaatcaacatcttttttttttttttttctgagatgtagttttgctcttgttgcccaggctggagtgcaatggtaaatcttggttcacagcaacctccgccccccaagttcaagctattttcatgcctcagcctcccaagtagctgggattacaggcatacgccaccatgtccagctaatttttgttttttttagtagatacagggttttactatgttggtcaggctggtctcgaactcctgaccacaggtgatccacccatctcagccagaataaaaatcttaatgatcactaatcaattcattgccttaacaacttacctccaagaacaacataaatttgctttaaacatggactgtggtaaagatgtttgcatcttctaattaagctgtgtttcattcagcaaatctgttttgagccgtagctgcgtgtcagctttattccaggcactagggatacagagatgtcaaggacaagacaaatacgtcattggctttatgggacttacatttcagtgtgttgtggggtagggctatgtgggtgtgggtgtgtgatttgcactctcagctatgccctagttattcttactgcttcaggaaaaggaccgcacattttatggaataaataacaataaaatatgtcaattatggagtgtatatcaagtgcaatgatctatgctagttgctttcaatctgttattttattaattattgtaacaattcaaatctttggcataaattttgtatcattaacacattagacaacagtcgccgaaatgttcactaaacttcccaaggtcagcaccaagtgagtggctgagtgagatggtgaatgatcagctctgtcccacttccatgaacctctgaacaatggacacgtgaagtttctgtgggacttgaagaaacaaagtgagtgaaaacgagtttcacctctttcacaatccaacacgccacccccaactccccgccactgacaaccagaggctggcaatttttgagttgggcattttctcaacagttgagcaggagtgtgatattcccagagagatggaattgggggctgtgcacaccgcagctgcgggccccaggaaggacagatggtccatgccgtacgctgtctgcttgtacagctcagcaaatacattttccttgactttaattgcacccggcagacagggacaaatacatttgctttgcttttaacaatactttggtggtatctggagcatgcatgagcatggcagttaaatgttcctctattcgctgctctgaaaagggagcctacggcttggttgctttctcagtctcttctctctctctcccccttcatatatatatatataaaatatatatatattatatatataaaatatatatatattatatatataaaatatatatattatatatataaaatatatatattatatatataaaatatatatatattatatataaaatatatatattatatatatataaaatatatatataatatatatataaaatatatataatatatatataaatatatatattatatatataaaatatataaatatatatatattatatatataaaatatatataatatatataaaatatatatatattatatatataaaatatatatatattatatatataacatatatatgtgtgcacatcctggtgtatataatttagcttctcttcctctctgagattggtaatttttttatttttctaatttttattctggtataattaaaatgtagcagatattacatttaagagttccatgtgctttgcagatgtccatctaatcaccaccaaaacaacatgtaaagcatttccatgaccccagggaatttctccatcaccctttctggccaattcttctcaactcctaaaagcaaccactttttgatttccatcatcataaatagcttttgctcttggaattcaatataaatagaatcatacaactttgtgtctggctttcttgggtccgtaaaatatttttgagattcaccaccgatggtgcttaaattgatagttcattccctttattggctgtgatatatttcagtgtataaatagtcaacattttaaatctattttcctgttaatgggcatttgggttgttttctgtttggggctcttttgacgaaaactacaacacacatttgtatacaagtgatacttgaggacactcatttttcatgaatttattgagaagcaattgacacaatacaatgaaatatttcagatgtataattagaccaaatttgacaaataaaaccatcacgacaatccaaataatgaacttatccaccactccacccaaagtttcctgtggttccttgcagtctccatctccctgttttgacctgcaccatccacagtcaaccactgaatggctttgtgccaccatagattcacgtaaatattctggaatataaaaaggaatcataggccggttgtggtggctcactcctgtaatctcagcattttgggagggcaaggcaggcagattgcttgagctcaggaggtcaagaccagcccgggcaacatgacgaaacctcatctctacaaaaaattcaaaaattagctgggtgtggtcactcatgcctgtggtcccagctactcaggaggctgaggtgggaggatcatttgagcccaggaggtcgaggatacagtgagctgagatcacatcactgcactccagccttagtgacacagctagaccctgtctccaaaaaaggggggcagagggtgaattatagactattgttttatcagccttcttttattgagcctgataatgttgagacttaaaaaggttattgtgtccataaattgttctttctttttccttgtgaagcagtattctactgtgggattataatgtttctgtttttctttttaaaactttttaaactttttttgctaaggaaatgctggtgttatttttacttcaaagataatcacaatgaacacaaacattttagcggatgatgttggaaagcctgcctggagaaagaccagcagcgcaggcttcattttaatcaccaaatacatcaatattggcaaaagaaagcttttagattgctaaattattcttccttgcattgtcaactggaagctagggttctttctggtgagtcaaatgaatagtatcaccattatcatcctcattgatcctcacccatgatgtgggccgtgatgaagccaagctcaaggggcagctagcattcagtatcggaggagcagaggccccgcagctggaatcatttcaggatctgagacatgctcaataggtgaagcctcagacaaatgctggggtcaggagaggagacgccaggagactagtgggttgaatgcagagttggagttgtggtgtgaagatagtcagaggatatgtgtgtctgtgtctgtgtgtatgtgagagagagcgtgtgtttgtcttaggaagcgtgtgctcctttgccttgtatatgatcttacctggctccgtgatattcctacaaagccttttgcaggaactgcatttgtctcacacctcacaggctgcaaggccttatcccaggtgaaatttaatttgacactgtaaagacttaaaaagagctatgattgttagcaccatttttacagatgagaaaactaagaaatatgggaagatattaataaaagtcatctatttatttgaagatattcacagtgaagactagagcccaggcatttgggcatcttgtctggagcttttctcccttttccctacagcactgtcctccatacaatggtgtgaggcttaagcacacccagaaagacccagtggtcatctacagggtatgattttagagaagtataggaaagcctccatcacccatctagtaccagctctgctacttaagaactgtcatataaagtgaaaagaggaccactgggtatagtggttaaatatacccacaatctgttcattagccagttttgtcttcctagatttgcaaagggagaaggtagaaaccgcaaaatgctcttttatcctcctcttttcccaaaatgagtggcataatcacaaggaagcccctgtacacagaaatatatatgccagaatgctcaggactcagatatatgactctatgaatggatggatggatggatggacgaatggatggatggacgaatggatggatggagatatggttcggctgtgtccccactcaaatttcaccttgaattgtaataatccccatgtgtcaagggcggggccagatggagataattgaatcatatgggtggtttcccccatactgttctcatggttgtgaataagtctcatgagatctgatggttttataaatgtgaattcctttgcacaagttctcttgcctgtcaccatgtaagatgtggctttgttcttcatttgctttctgccatgattgtgaggcctccccaagcatgtagaactgtgagtcaattaaacctctttcctttctaaattgcctggtctcaggtgggtctttattagcagcatgagaacagactaatacagatagatatgtaggtaggtaggtagatagatagacagacagatgatagacaaatagataacagatagatgataaatagatagatgataaataatagataaatagatagttaatagattgatagaaaaataggtagacagatgatagatggatagatgataggtagtttgataatagataataatacatagattaggtagatagacagatgatagacagataaacagataatagatggatagatagatgataaataggtgataaataatgaatagatagctaataggttgatagaaaaataggtagacagactgataggtgatggctagatagatgacagacagatttataatagataatacatagattagatagatagatagatagttgagagatagatagatagagatagacagacagatgttggtgtggattcagctggttctggggtgaagggttctggaccagctgtttgctgctaacccaaaggtcatgactagagctatgtgtaagctaacaagtgcttgggtatctgtggacacaagggacacatgaggacataagcacctgggaacagctaagagaaggcagtggatattgaaatgactttatcatatttatggagagctcctttgctgaagtatgctctcaattctgttcctccaggagtcttcattttaaacaagatttcaaggtagttgggatgttattattgttccacatgtcaacaactcttgacgggttcatttatattttaccatagagatatctgtgaagccctattaggctgcagctaaaagacatttttcttcctgtttctttcctccattcactgaactgacatattgtgttttgttctgtattatcttttggtgctttatggaaaaatgtccacatttctcatgcagctaccccaaggtatttcttgtgagaaaaagaaaaatatgactctttttatgagaagagaaacggtttccccactctttccaattgtgtattcatttcaataagcctggatcacttgacagaagggacttcaaagttgatgatgatgatgaattacaaaactaaataagaagtttggaagaacagggacaaatctactcttggccatgcatggtggcttatgcctatattcccagcactttgggacactgaggtggtcaggatcatttgagcccaggagttcaagaccagcctgggcaaaatgtcaaaaccccattgctaccaaaaatacaaaaattagctgggtatggtggcgtgcacctgtagtctcaactacctggagaggctgacatgggaagatcacctgagcccatggaggtagaggctgcagtgagccctgatggtgcctctgcactccagcctgggcaacagagtaagagcctgtctcaaaacaaaacaaaaaaaaacaaaaaaatatattctcatgaagtttgtaatggctgtgacctggtagaaatgcataaatagactatctattttcacaaagaccatattaccatataacttagcaggtatattggagtttaagaaatagctagaattaaattatttcaaaatcaatttcaaaattcacctttgtgaaatttagaaactttgtcataaaatcattgcatttctaagctaaaagaatccaagacaagtgatgtcattcatgtaggtgtctccatcaatccaacagtggatcatttgagcagcattttccctgtgtatgatacaagcaaattaataagcatgaaccctgccctgcaacttgtacccaaggctcaagcttaggaaaccaaggagggagaccataacacagtacctgcatgtaaatggcatccagtttcagaaaaggaaggaatctgagctggagggctgcatggaaggggtggaatttaacgttggctttgaaaatcacataacatttgaaaaggtggaaccaaatgtgaagatttgaggcactggggcttctgtgagcaagccacagaggcaggaataagcacagttcacagccaggggagaatgtagggccaccacataggagatggagctgactcttgacttcagttttctgatccaggagtgtaatatacctcaagtagtcaaagattggaaaaatacttgactccttcaagacagaatccaatggggaaaacacatctataaacagcttatcgcatatgaggtaaccccggtggctatgtatggctccctgatgtcgagagcagtgcgtgcgtgagttttctcctgctcctttcctctctcctgaggctgaaagctgcacaccctctgtgtgattcccctcagcaagtatgctcattcatgccagtctgtggatgtctgagaatgtcttgatacacaaccatccttaggggtaactgaaattaactgggcatgttgctcttaaaagtcggataaggagtacaacagtataggtcagaaactttggagatatagaggctaccttcccaaggcctgctgtgcctagacacaggatgaccattctcagagaagaaaccctaaaatgacaggaacgaggcttttgtgtctgcacctcaagttctctattcttcttttcttagactggaaatcccagctgcttcttttttctttactgctgttactttccccatatttcatctctcccgagatgttttatgcattgtgggaaacgtgcacagctgctgcacctgcacatttggctcttcccttcatctatacttcaccaaccattcaggtctccgtctaacggtagatttgccattgatcccttgtgaaacattatatctgtacatatttatgtgttctatattttgagttacagaattaggtggatacctttaaaattgctatttcttcttagggaagcaaactactaacctataatcattatttttatttttaaaatgcttcccttcttgtattttctctggtggtactgtagtttatagcttctccagtcatatatattgctatattaatagcattgcctaagtaaaaacaaaacagtatttgtctgatatctttttaaaatgtttcattaatttctccaacattattgaggtataattgccaaaaaattttgtttatatgtacagtgtacaacatataccatgatgtttttccatcctttgactttcaagttttctgtgttcttatgatttatgtcttttaactgaagaattttggccagcattctggtcactgatatgattgaattcatttcttctgtactaatttttctttgtatttgtgcccttttttctcctgtttttttttttttcttcctgttttggaatgattaaggtctgtttttcttgctggcattcttttagttccattttcccctctactagtttggatgttactctttctatatctttccctatctctaagaattttaacatgtagacctttaaaaagtgtaagggatgaccaatgtttacaacttagacacattataatgctttaacttgggtcactcattcctaactatcctaacccttgtattattgtttctaacctccaaggacacatttttttaaaaacacacttactgctttttttagatttctctgtgtgccattttctttccttactattattttcacatctcaactctgtcactgttttctttatttctgaaacacaactttttgaacactgatatttaatgtgtggtctgtatattagcactggtctgtaaattgttacttactgctccgaatctaataagcagattgatccaaatgcaaattagctacctcattaagaacgctttattgcaggggacatgtttttcacagcaagactttctcaatgaaagaggcagtctgttgatttgcattccctcagggttttgttgttgtttttaaatgtttttattttgttttcattctggaaaaatggttttgtgggataataatcagttaagaaatcttccctttctatttgctggttatgttgttgagaaagtagctcttaagctaatgatcatttctttgcagatattctgtctttttccctctgaaaggcaaagactgtttgtccacgttgttcttcgttttcagtctcatatttctaggtatagatttctttttatttctcctgcataggattcactgggatttctgaatctgaagattggcttttgaacaatcatagacaattccctttcatagtctcctcaaatagtgtctcttttccacatcctgtgttgtctctttctgatacttcaaagggattaatttgagacttcttacttaatcctctctgtttctttacctgtcttaaacttggtagttctctaagcggcaacattgtactttctccagatctattttccaggccaacaattctcttaatagcatcatggctagaaagaagtatagataaaatagaaagacagaaacgatgattagatagacagacagatggattcttacaggaaatatgaggtctccagataagagaacagtctttattactcacagaacatcttggccccagatcgccactggactatacatatgtttctgctttaaattgtataggtgaatatatgggggacatatgttcacctgtacaatttgtggactcctgtggccatattaaattatcatcatttctttaatgtgctcatctcttccgacttcctactgttttctctaaataggaagcctccatacctctcttcatttagacagagtcttctagttcgttacatctcatcttacttcaagtaccacacccgataggaagtcttctttgaacgtctttgctgctttagcaacctgtacttatctctctcaaggcattcatcacacagttttttaatgaacagattattgtttgtctcttttatttcactttcaagcccttgggggcaagatatcttttttattcttatttcgcaatacctatctgaaatcctggtacatagtaattttcagtgttttcctactactctaatcaaataatcattgctctccagttttccatttattattattattttgtaagattatattagaatcataaaatgttagatgtagatggaaacctaggggacatctattttacatgatataaaattgctatcagtattttttctttgttttaacgactgacatcagttgggaaactcttagccccgccttatctcacatctcctggatcagcataagtttatgtgcctaaaatctcatttcatgggagaaaggaaaatgggtatcttgcagcaagaatgtaaggggaggacaatgtcactgggtaagcaaaacagagtttgtaaatttatcagtacttcttcccacccagaaaaggctcagtttagagaaaaaaaaagttacagacatttctattttcaacattttccctaacatccagtactgagttccaccagctatgtctaagttgacaaggcagcaacttcagttcatttgttcaagtgtactttgatttgcatagtttcataacctgttagcatctgctcattgataattctgagcttgtgctttcctgacgattttttactgcagaggtggaaaagtactaaacggcaatttgtttctttaattttcctgtgcaaacaaagtcagggaacaaagaaagatgcatggtgactgcaaaatatcattattattttatcaacaatgataatacaatactccatgagtacaacttcttagtaataaatgcacataaaagcaagatagccaggaagtgcaaaggacaaattcccataatgctacatgaattgttttgcatagggcccactgtagcctcctgctgcctaatagataaattgaaaattttgcaactctacatctatctcaccagctttcagactgtgcactagctatgccaaattgactaatgtggatcgagactaattataaacataagtagaattcctagtacacctgtgataagatttcaggagctagtacttcagtatatgacattaggggccactgtcagcaatttctttagaaggaaaataagatctcactgggactctaaaggtacagtttatttatttatttatttatttatgagatggagtcttgctctgttgtccaggctagagtgtaatggcgtgatctctgctcaccgcaacctctgcctccccggttcaagcaattctgctgcctcagcctcccaagtagctgggattataggcatgtgccaccacgccctgctaattttttgtatttttagtagagacggggtttcaccatgttggccaggctgatctccaactcctgataaaggtacagtttaaaaggtacctcttttggagtaataaaaatgtatggactcaaatttgtcagaatgttaaatgggcaaaaggtggaggatactttctgaggaagaaacaggctagagagtgcacaagtaaatttaacgcttaaagtagaaaaagagttagaaagaatacaagggaaaaattacatctgatttccttttctgctaaccgaaatttagcctctacttccattatgcatccaggcagcagccacagttgcattagcaatacctgtgacggtctcaccagcagaaattatgactttcagtattttaataccacattcacagtggctccaaatatcttgaaatgtttactctcagcatgacttcgaaattataattgttattatatccaccacattaaatacagaatcacagaagttattatatcaaatatttgttgcttttaaagttttgcttaaaaacttcaatttctagtactacaatttcaatataatttattacctttgtcatctcatggctttctccttcttcttcctttagcatttataaactttattttgagaagtgtctacaaagtttgtcagactgcaaagaagtccatatctcataaaagatcaagctttaaaggtggaagaagaaaggaaaagtcagggttctgttaataaagttctgttttgcttctagcaaaaaaagcatatgctcccttatgaatacactaatggacaatttaaaaatcaatgtcagcgtaatgatggtaagcacagcttccaaacagcatcccttctagattgccagaagatgatcacgcagaccccgaagcttagggggcagccagaggcctgaacccctgtcctaggttaattcaccttttgcatggtaacaattgaacaccatttacaaagtagggagaattattttgattgatattaattgaaacttgcaaacaagcacaaaaattaagtgagcaacaaaaggattaggaagtgaaacctcgcttttactaatcatttccctttccctctacaaaacaaacaaaaaaagatatgaaggtaaagaaactatctactccaattactttaattcatttggatgaacattttactctatgaatttctagggatttgattctctgatctggccatactcacttgtaatcaaacaaaacataaaattgaccatttttgtatgctaattttgtgctagacaccctgttgaataaatgaaagaatattattaagcatatactacatgccagatactttcctatatcaaagattggcaaacttttttctgtacagggccagataataaatattttcgattttgcaggccacaaggcagtctctgttgcaactgagggcagtacaaaaacagttataggcaatatatacacaatgggtgattgcattccaatacaactttatttgcaaaaacagttatagacaatacatacacaatgggtgattgcattccaatacaactttatttgcaaaaacaggcactggagcatatttagcccacggcctgtagtttgccagcttctgacctagatattgcagcgtggaacaaaaggtcaaaaattccctattttgtggagcttacatgccaggaggggaagacgaaccaggagcaaagtgaacatactaattctatggggtattttaaggtgccctggtgaggaatccagcagggacaaggcgggagggtcgtgggggagctcacaacctttgctatggtgacaggtggggcacctttgagaagcaaatattttataaaatttttggcagaaatgagcaagcaagccatgggcaagagtattctagctgcttagatcattataatgaccatccaggataaaaaatattatttctctctgacaggagaaaatggagactcatttccttgtcaaaattctaatggctaagctcatccagaccatgaaatcggtaattctgggagcaggttaaaggccttgctgttttttctttctaaagctctctaggttattttaacatgcagctatggttgacagtcttcactaggtcatgctgacttttaacttattcaatttattttaaagaaaacaagctaacagaaaaatactttgataggcaaaaattaagttcatagggtcagatattcatttttgatttttattattttagatctagtcctgaattcagatttctttctttctttctctgtctttctttctttctctttctttctttctttcctttctttctttcttttctttctttctttctttctttctttctttttctttcttctttctctttctttcttttctttctgtcttttctttctttctttttgtatgtgtcagacattctatagcttctgagattctcattgtgtttgtgaagatattctgaaaagaagacagtaaaggacttattagggaaaattaaagtaggatctggggaaggctggagagaccacaatacaggagggtgagagaattaatatgaccctgaggcaaaatgtaagtgaatatttttgccccttccaagtaaatatgaattatttctaatcatctttgctaattagaatgggaaaaacacatttatcaaatcaatggttgcctgcaatagacatgaggccatatttgtctgctccagcaactataccatatctgtctgcaagcacagctattatttattcatctgtgctcatcaatagtctttttccaggatctgtccagtttttgcaggagccaaattgatgagttaaatggagacgtaacagggatcacccttgctgtattcttatgttggatctttaatggtggcacaagtctttgctgtctctcccaggatacaatattgttttttatttactattttggcagaggggtgagagggaatttcagaggtttccacttggcctttctccatgatgacagtttttttctcacattgcagaaacccaataagggggttcctacaattactaaggacgtccgttccaattatgtacttggagattgtagaaatgacctttgagtagattcatggacctagcagaccactgaaaggtggactttagccacaatttctaatttggcctaactctcatagccctctgtgctccaaagctgggctatgatggatctttggatttttattcgggtcaatcaatgtcaattcgggccctttattaagtagtctttgaaatggcttgttattcttttttcctcagtataaagaagcctaagtaaatggctacaggtccctttgaggaagattgagggcgttttcacagcatatgccatggtatggtagggtctttcttcctaggaataatgccagtggattctgaatttgaaaatttggctgaggtctggcaactgagcaggaacttggacttgttaacagtgtgactgtgcttgactttctgatactccgttctaactttttttcctagttatagatgttaagcaacattcttcttggctgcctattcatttacccactacagacactctattaaccatctcctcaagtccctgtgggccacacccccttggtcgcacctctaacctcctggcgtctagcggtgaagccccagaacctggcttctcctggcatggagctccatcatcttcatgatgttgttgagtggactcctttgactgcctctccaaccaccagaagagccaccaccaaacttattattgatgatggtgcccctctcccagcacattctttatggtcttagtgaagagtgagctttctgctccttctcttggactatgaccttctcttgggtcttttggtctgacataatatgcaatctctgcttccttcagcatatcctctggcttctgacagggcaatttgggcatttccattctgctgagtattgggcattgctgttttcaagtttctaagggctgctctaggaacatggttgcatcatttctaatcccaggagtgctcctctggttcctgctcatacaaaacagctaattcattcaactctttgggtgtatagagtccctcctccctgatcagggccagcatgttcccaactgggctatattagcatttccttcttggtattggcctggcaggaaaggagacatatctgtccagacatatgtccttgtaccacggtctctggtctcagtccttttctcacctgagcagtgacctcagccatgcattcatatgtccctggagctctgcagctctaaaaattaggtcttcctaattgtctgagctatgtcattcccttccactgtaggagatatgagcctccttgtaaactagcacagaggccctctggcttccagccttacccattaacgactcaacagccctcagtctcattatccttctgcagggtctttttttaatgctataatttttcctcaaagtcctgctttagctacctcataattttgatatgttacatactcatttttagtacaaaatatgttttgatttttctgagtattcccagttttctccataagtatttagaattactttaatttccaaatattcagggacaatcatatcattttccttagttatttgtagttaatttcattgcaattcaagaatatactccatatggtttgagtttattaaggtttttaatatattaggatataattattcttattgaatgaaccatgtttacttgagaagcctgtgtattttgctgttttggggtggaatgttctctacgtgtcagttaagccaactaattttgtttttgctttatgctcccacatcacatgtgtttatttttttttacaactttcattttaggtttgggggtacatgcacagttttgttcatgtataaattatgtgtcactagggtttggtgtacaaatgattttgtcacgcaggtagtgagcatagtagacaacaggtagtttttggaccttcatcctactcccaccctacctcctcaagtaggcttctgtgtctattggtcccatctttgtgtccacacgtactcagggtttcacacccacttataagtgacaatacacggtatttggttttctgttcctgtgttaacatctcacatcagttagaatggctattataagaaagtcaaaaaacaacagatattggcgaggttgcagagaaagggaatgcttatatactgttgatgggaatgtaagttagttcagctgctgtggaaagcagtttggagatttctcaaagaacttaaaacagaactaccattcagcccagcagtcccattactgggtgtatacccaaaggaatataaattgttctaccaggaagacacaggtacatatatgttcattgcagcactattcacaatagtaaagacatggactcaacctagatgtccatccatggaggactggataaaaaaaatgtggtacatacactccatggaatactacactgtcataaaaaaatgaaaccatgtcctttgcagccacatggatgcagcttctgtagggtcttaatacaacttagtgataaccaattgactctcatgtatctctacattgtttcgctgttgtgtatttctctagaggtgggaagaaaggaacacatgattgttgttacttggagaaaccacttaaatttctatttcaaagcatgtgtccatttttgagtgagttcctaaaaatattattttcccagtcaaatagaatttgtaacagcccaagatattcaagctttagagaacctgcaatatttcctaatcaatgagtaaacttcagatatacacactcatgtacacatatgcacccttggtaagaaaggacggagctgtgtcttggggtaaattatactataaggtgaaaatacttctctcttgctgttggcaaacgatcattccaaagacatgccactgcaaatggtttctcctgctagttactagcaagagtctgcatatgtagagccatctcttcactgttcatttttcaaggggcactgggctccctgggcaaactgctcccttgcagtgagcttgactctgtactctggaagggagtgggtaggtgatccaagactgacagtttatattcatctgactaggtaagtgtattgagtccaggtatacacagcagtccccacagagggcacctaaggtctagatttcaggaagacatatgggagactactagcgttcaagtcaaaaccctactgagtctaaagaaatgatgtagttcagatatgctgggcatctgcctagtctgttaacaggctgatccatttatcctgctccataagagaaaaactcaaaagcaaaaaaaaaaaaaaatcccctacaaaacttttggcagatttctgattgccctaggaagcatcttcaccccagcaaggagcattttcttccattaaacacgcaatctacagagaattaggacatgttcttatgctgtgacttttggagcattttaatttcttttttctagttcaaaattttcctggaaaataatgaagtgaactcagacaccacaggctctataattatgagatttttgtggaaaatcctggggacaatttggtttaatgcatatttatttaaatgtcataaaactcaactcatcaaagttgtagggccactttcaaacttgatgccatattcgaggaagacaggaaatgtagcagagtaagcctatgtcctctggaaattgattttgttacctgaatgtcaggggttcagtctaggtgctgttgcttgctgcaccgaaagccagtcattgatataacaagtactgccacggaagacagctttaattgggtgctgtaggagagcagatggcagatcagtcttaaatccacctgcctgagcaactgaaatgatgggtgtatgtagtgaggaagaaatgtaaccaagtgtgggaaagcaggaataagggaggggtaaagaagaagaactggtcaacaggaagcaggtttaggtaatcaccacaggtgatgagtctagtttctcatggtccagatgccatgatctggtaagtttcgctctttgatactgtctgggaggcctgatcctttattttctgagaaaggaactcagataatacaaatgtaacatgtttaagttttaagactgggaaggtcaatttttatgtttatttaaaagaaacaataaacatcagttctataggacaattgggaggcttttttatatctcaaagaactacaaacgttatgataagcaatttatacttgattctgccatgtatctacctttcttattataatataggatcagggttccaatgttgaaatggacaaaagccatcattccaaacaccccactggttctccaagccatgcccaagcacatcactctcatcaatatggggtatctctaaagaggggtaaatcatttctctctctccagcactcaacacccaacatgtatactcaagtttgcaggtgggtacacgaaaggacagttcttcttcacaaaacactagttacccttggcttcgctatgacacatttaagtggagaacattagggaacagtcaaaggtgtgttgaaattaattctcaagtattcaagctcagactgctaggtaccctactgactgagtctatacccaatgataccagcgaaaatgctgggaaaaaaaaaatgaaaaaaaactgtacttagcaaccctgcaacagcaagtcagggtacattatactgtaacttcttccatctggcagatgtatgcttcattacatctgcacagttagaggggatcgcatggcatattgtttcaattattatcaatagccaataccgatgggccgcttgccactaaaaaggatcaacatgtaatttagaaaaacggcataaactataagtacaaattgtactatttattactatcccgttattaatttgtacttctggatattatgattggtatttggtaatttccagctacttggaaataagaacatcctctgagagctaaacaataaaatcaatccacaaaaaaccaaagacgcgtgatgcaatgtcaccagggagagaaaagggatctcaggttacagcaagaatttactacaatcagattaaaggtattaatttagttaaagaagtgaggatgctagagctctgcatggatcacagaaaaaaatattaaaatcgggtaaaaacaaaaaccccaaacagcttcagtggacatcaggagacttgagggccatttgcacctgagactggaaagctatgcagacttaggcaactggaaattaaattctagaggataaagaggtgtaggataatttgctctgtccctgaaaaatggcagcctttatatatttcagaaccagccagaggacattacccatgcatgactttatcttcctgtgtagactccaagggtgctgttgggtccgctctgccgccatctttacacagcgtgggcagaggcacatccaccaccctctgctggtcttcaagtacacgtcattcagcagcgtgatatcctgtaagcagccagtatacgtaaaaacagcccagccatgggacagctctctcatccacaacctgcagaaaagagtcaagaagggcttaccgctgctgaatctgccgagttgtcatctgtttaaagtttgctcttatataaatatcacccacaattgagacagctgttgggcccagatatcacacaatatgtcatattaataaaaacaataaacacacaggcattattttaccttaatgccattgaaaagcaatttaattcgaggacacatcctattcccagcatgttatttttaatacaattagatggtcagagaagttttaatagcaaggtacttcaaatccaatattagttctgaagataccagatattgttttatgcaaagcttttaaatcacaataaaatagttatgacacagcaataacttagcagtcttttcccattaggggtaaatttcatcatattactctaaaatatttcatatagtgtaaatctactctttatttactttccgtaatgtctatggtatgcttagtatcatgtattcttcctgaaataaacagccctttctctgacctgccctaatgcttgccattttcagcctctgcatcctccaagcagccccttcattagaccactttagtctttagagtacggacaggccagtaagctcctgtagcccttattagttacaatatgatattccttataaatttgtttgcaatgtatgctgcattaaattgcacattttggagcgagggcaatgaatactttatatgtccatgttctccaaagaacttaagaaaatgctgaagaaagtaagaacttcagaaatacatgttgattaagtcactgataggaattttggagaattcgtgtgtgtattttctttcatcgcaaacacacacacacacacatgcacacgcacacacacacagacacatacacaaacacacacggagggattaaaattttcaaccaaattgaaatgtcgaagttaaagcgcttaaaaagaggtggtgtcaattctcattactcatggtagctgtgttctatgaagttgctgggaacagagcaaacactggactatggtttctatggaaaacacagggttaggtttcttagagcctatggtcataaaaattataaccttgctttatatttatttctattttaaaaaattaatatatattgttgattcaagcgataattgcttctcacttatatggagaaaagtcagaaaaaggataataagcaaaaacctaatggcttttatatcttagtaatattgagtatacacagtaattttctgtgtatggaagaaattattcctctaagctagtgctaataaaatgattcatttggaattaatacaatcctaaatctaatttagcctatacttaagaaaatgtacattctattatcaatacattccctatacctattttccttattattttaaaacttgtctgacacaaaccatcatcaatctttaggtttttaggcttttaatatctaatatagtattgaattccttgtgatgtagagaaaatctatagtaaccatgttttaaaagggttgaatactgttataattctataaaatgggtaaaaagcatttttattaaattaaaaaatcttactctctttcaaatttgatttatcacaaaattagcctgtcttcattttttcctaaaataggaaaaaaaagcagttaattttagttttaaagacatcataagtttaagaataacttatgaaaaataacaaccaataaagtaatcagaatttagtgttgaacatgagtaagatattgagaattaaatctggcaggagagttagggacaataaacgaccattgaactagaaatgagaagatttccactgttgctccagatctgatgctgatctggtcatggtggacaggtcacacgtgtcactgttcattcagtaaatattatcaagtgactactatatgccaggtgctatagggagaattggggtacaccagcaaaaaatagagaggcccctcattcttgtttgctgatgttatagatattccatccagatttacattttcatggttccatgagtaaacttgacacctgctccctaggtgaccgcatccaatctcatccttttaagcactctccacatagtaactacatccaattttttatcccaagtctgtagctctcttccaaaatctaggtttacatatccagctgcttggatgcttaatcggcatctcaaccctagccagacttctgatcttccaccccacctgctctcccgcagtcttcttcacctcaattagtggccactgaagccaaacttccgggagccatcctaaagatccctcttttccaccaccaagatttcctttggctctgtattgaaactaccatcccccagaacccactggcttctcccctccacacgcaatggccttgcctggattcctgaaatagcctcctaatccgtcgtactgcacctgcccttaaccctcacactgaaatctcaacactgtagctaaggtgatattttaaaaattcaagtcggctgggcgaggtggctcaagcctgtaatcccagcactttgggaggccgaggcgggctgatcacgaggtcaggagatcaagaccatcctggctaacacggtgaaaccccgtctctagcaaaaatacaaaaaattagccgggcgtggtggcgggcgcctgtggtcccagctactcgggaggctgaggcaggagaatggcgtgaacccgggaggcagagcttgcagtgagccgagatcgcgccactgcactccagcctgggcgacagagcgagactccgtctcaaaaaaaaaaaaaaaaaaaaaaaaaaaaaaatcaagtcagattctgtcacttcttgctcatttattctaataactaaatacctacatttagaaaaacatccaatcactttacagtggcctcaatgtaaccaacagccccacataatctaccccatttcctctgcgaagctccagccacccctcatccgctccagggcagccctgcagctccctggccccattgcacatgcgacatgcagagcactgcgagttcagtgtcaatggatccaccatgtaccctaacccatcacagtccccggaagtgaggccttatcacgtggagtaaagtggaggatcgcccttcctttaggtgtctttccacttcccatcttttaaatatacatgtctcaggtatttcttctacatgcattgagcatcccatcagatggcatagtaacttttgcttcaaacatcaaatatcgcttttaaaaactcatgaggtatggccaggcacagtggctcacacctgtaatcccagcacagtgggaggccgaggcgggcgaatcacctgaggtcaggagttcgagaggagcctggccaacatggcgaaaccccatctctactaaaaacacagaaaattagctgggtgtggtgtctggcgcctgtaatcccagctacttaggaggctgagacaggagaatggcttgaacccaggagccacaggttgcagcgagcccagatcatgccactgcactccagcctgggaaacagaatgagactccatctcaaaaataataataataaaataaataaaaaacaaaaataaaaaaatgcttctgtcagcccttctgtaagggtaggtttattatgcaactaatttctcttgttttcttttgtctagaaaacctctttatttccctttcattctggaaggataatttctgtgggtatagaattggcaggtgactattattttctttcagcacttggaaaagcacttcattcatttctggtctccatggtttgagatgagaaatctgctaccatttgaattggtgttctcctgtaagcaacatttcatttctccctggctgctttaaacatttttctgttttatcttggactccaagtatacaaatgtgagctcttttgttattgacccatgagactctgctgccctataattgttttctctgtttttcagatggaacaaattccactgagctatcctcaaggtcacggattccatcctctgtcacctccacttcattgagatgacatattgagcccatgcatagccttttatttgaggtattctcgtgattttcatttttaattctaggctctacttttgctgaaattttctatttttttcatttgtttcaagagaacccataattgcttattgaagcatttttatgacaattattctaaaattctttgcaggtaatcccagcacctgagtcatctttatgttggagtctcaattgactcttcattcatttgtgatttttctggttcttgctatgataaatggttttttattgtattctggacattttgataagattgtgaatcctatttactttttttttttttttttgagacggagtctagctctatctccaggctggagtgcagtggtgcgatctcagctcactgcaacctccgcctcctgggttcaatcgattctcctgccacagcctcctgagtagctgggattgcaagcgtgcaccatcacgcccggctcatttttgtatttttagtagagatggggtttcaccatgttggccaggatgttctcgatctcctgatctcgtgatctgcccacctcggcctcccaaagtgttgggagtacaggcgtgagccaccgcacccggcctactcttttttttttttttttttttaatagccagcttctctgttgagatgtagcaccagggctgtgtatctgttcagtctcctttgggcccagggccagtacgggagggaagggagagcagaacgcggaccactctaccttgcattgcctcattgtgtatcatcgatgcctggtggaagtgggcttactctgcatcctgctgacaccgcagagaaactggagcccatggcctgcttccctgggacaggagctagggtggaaaatcagcttccagcttggccctgctgaaaccctggcaggggcaggttccactgtggtttggctggaatcgagcaggtattgccaacagcatcgtctattgttggagtacctttgccccagaccctgagatggggtaatttttaaagaaaagaggttcaattggctcacaagcctgaaggctgtacaagcatggtgcccagcttctggggaggcctcagggagctttgactcacagaggaaggtgaagtgggagcaggcacttcacatggcaaaagcaagaacaaaagagtgggaggcagttgccacacacttctacatgaccagatctcttgtgaactcagagctcactcatcacccaagagatggcccacgccatccatgaggaatgcactcccatgatataaacacccccaccaggccccgcctccaagagtggagattacagttcaacacgagatttggtgggggcatatcaaaactacattaaccttaaattatgaagacggtaaactaaataatctgctttctttcctttcctgttttgtgtctgtttttcagatttccaaggccagcaatgttctcttcctctcccttttctttgtataaaaattcattctcaagaaaaactctcatatcaattgtttacatgtcactatggctaagacactaaaagccctctccctgcaaaactggtggcaaagctctctagagaaccacaaactgttgcatccttactacgtggggcagcagcaagcccaggtgaagatgtgcatgttcttggagaaagtattaataacataccgacacttacacctgggtgaataatttcatcaaatctcttaactcacacttgcacagacttcacctggagagagagagggaaagctgtgccagaaaataatgggtattgaggtcaccatttgtttgtttttctcaggagtggaaggagattaaccagggtggcaataaacaaaattacttgctgttttaaaacttaatgacaaccctataggttattaacaatgccaaagttgcagggcgcagtggctcacgcctgtaatcccagcactttgggaggctgaggcgggcggatcatctgaggtcgggagttcgagaccagcctgaccaacatggagaaacccatctttactaaaaatacgaaaaaaattagccgggtgtggtggtgcatacctgtaaccccagctactcaggaagctgaggcgggagaattgcttgaacagaggaggcggaggttgcgatgagccgagatcacgccattgtactccagcctgggcagcaagagtaaaactcagtctcaaaaaatacaaaacaaaacaaaaagccaaagtggaaaagcaaaaattttgtggtatttgcattcaattattatgctttaattcaaccattcacaatttctagggaacattaattttattgcaatcccaggtaaatttaggataatttaacaataatcgttggtgttctactcatctacttgtctttaaaatccacatatattttttaaaagatgacatcctttaaaaatattatattcagtgaattttcaatattattttaaatattgtcatggacagttgttattggaaatgacagttcaccattgcaaatcaatgcagtggctacaagtcccccgtgtcacacaaaaatagacggggtagctctgacagcatgcatccttatgccctgttctattaataatgcactgcgccccatcagggtctgcagctatatcattactcacagagacggttctgcctttggctttccctggtcctccatggctaggaacatcatttaacagggttttacagaattcactgggtggttagtcttagaaaacccaaggcacaaacacacagccaactacccccaagtgcttgtgcttgaactttcagaacataagaaaattgtgttgaagctggatctgcaagtacaaatggagagtgaaatgggttctatagaatccaaatgacacactctttcctcctgctaagaattactggctattgaaccaattcctgcctattaactgtgaggtgaagtccaagatccacagtcaagcattcaaagatccaacctgatttttctctgcataactgttttactaggagtaagactgacttgcctggtttaccaagacagtctgtgagaattcttcccgcttacctttactgagtcaatgtggacagtttgaaataacttaaaacattcttcttacatttttaaatcctacacaagcctcaaaacaaaatccaagtcacttttcctctgcagggtcttcactgagccccccagcaggcattcctcttgctatctcctgtgtgaatagctctgaaggtctgcattgcaaatatgacagtcaacacaccggctaaggtagaacaaaaagtggcattattaagctgaaaaaagcccggaccaaaatgaaagattcttattgtgggagcaattgctcacactcaccaatagctgcttgtttccttcttgggcacacagaaattacaattcccaactttcctgcagttggatagagccatgtgagtaattccagcctggggactctgactagagatgaaaatcccctccacggtggagcaaaatcccctgagtggccctccagccttctgttctccagctgtgctaacctggaagccacacattgagatgacagagcagcaaagtggagacaggccatgtctctgagtcaccatgtgacccacaggagattttgagtaaattaaaatacaaatctttgtcataataaaccacagatatttcagcaatgatttgcaaccatagcgtaagataacctatcatggctaatgctcctaggttctcaacctgtatccaccagtaactagatagcttgggcaaattatcttctatgcaacctctggttgataatgaattccttttataagtaagagaatgagctggaacccaaatgcgtacagaggaaatctgaatgaagtgggaagggtaagacgcagagtgagtggagacttcactcattgttgaaagagggcaattgctactcagttattactgatgcttacatgaagaaatccagttttaatataaccacatcttgccatttctcaagggaagtcatgtactatctgtgtatctgtccttcatatagctccatcaatattctcctcttaaatcttggagactgtgcaggatgttttccaaatgtctctcctgatccagcctgcagtcttctctaccctggtttgggtatctggagccagacctgtatgtactgcatcagcaggttctcttcccttcgctttctgcatgggttccaccaccataaggtcctggtgggagatcagaggctgggaagagcagaggctgggaagagcagaggcaggagaggcactgcataactcctctcaggcagccctctctctctggctctctgtaggtttgggcaactgctccttccatccatatattcaggctgagttgtggaaaaggctcccaaatggcattagctccagagtgatgcaccttccatatccttttattttcattatttctcctcctttgaagaagttgagtatttttgcaagaacattgactaacaggaactaatcaattattcttaaattaaaaaaattgaatgaatcaaatgttcaacaaaggatacacacacagactgaatgacaactaagttattttacagttccacaaacctagggagatctatcaatgaatggggtattacattctaatatttctaagactatattgaatattgaatattcaatattctaagactatattgaatattcaatattctaagactatattgaatattcaatattctaagactatattgaatactgaatgactacatcacctacaagaatacaatgagagtactaaactaacactcagtactaaacatttgtcctacactcagaggtagacaccaggttctggtgtcaatgtatgatatgcctgtctctaaataaacattttatcagataacagtctttgaaagtcccagtgcaatagtaagtatagtctggcctgtgtatccatgggttctgaattcgtggattcaaacaaccacagatcaaacaatattttaaaaaacaagtatggttgtatctgtactgaatgtgtacagactttttttgtatttccctaaacaatccagtgtaacaactatttccatagcatttacattgtattatatattataggtaatctatgatgatttaaagtatatgggaggattgtgtaggttatgcatgaatactacaccactttatagaaggaacttgagcatttgtggatttcggtatctgcaggagggtcctggaactaattccccatggataccaagggacaatggtatatacacaaagttttacacctgattataaaagtatgtgtatgatatttaaaagtaacttcaatctttgctccataacaaatgagaattaaccataagttccacccaaaataatatttagaaaactatacactagattactcttagtttttgtggctgtgtactaccgttatcctaaaatttgataaaatcattttaaatgccttttaaaatatttttttaccttggagattaccaccaagaaatgaaaaagaattctgaaccaaatcagaagtttgagatttgaaatctggctttgctactaacaaaccctgtaaacttagaaagtatagtgcaatcaattcacaacaggctttagaataggccatatgagtttgaattctgataccacgtttactaatcacgaaacttgatcataaagctattgtgagaagtaaccaagataacacacacaaagggcttagcatggtacagagcacacagtatatgaaataactctcatacagtaagtgttaactattattaagaattttaaaaataatttgtaatgcaagtgtcactgtcaagttgcacaggacccagaaagaggataagaacatatttacagcttttcttttattattttttaaaaaatcaaataaattcttgctgaaaaaactaaaggcagagggaggcaataagcagtatttggaatgaaaacaaaacaaaaaggtatttcctcttcacgcatttctcaaattccaaatcccctccctaccaccaccactgctgatactccttccctccacaaaaggaaatcactctttaggcttaggaaaagactggcaaaaagtatcttggaattttcacaaatgtgcatccacaacacacatacatactccttttctaaatacatcagatcgtactacacatctttttctgtgtcttggacttaaccattcaaattattataggtatcattcgatgccagtaactggagttctacctcatttctaattcattttattgtagtgtaatttacatacaatagaatgcgcatattttagttataggttttgatgcaattttatacatgtataggcttgagtagcctaccttgatcaagatgtagattttcccaactccgaaaagctccctgtgcccctttgcagacagtctggcctgccccatgctcagcagtgactgacctgctttttctactgcagattgtacagttcgtgcaaatggaacaatacagtggtgtcctctgttgtcctctgtttttcagtcaatgagtagtacttccatttatgaatatattcttcccccacccccacatttttttttttttttgagacaaagtctcactctgtcgcccaggctggagtgcagtggtgcgatcttgtctcactgcagcctccacctcccagggtcaagcgattctcctgcctcagcctcctgagtagctgggattacaggtgcttgccaccacgccaggctaatttttgtatttttaatagagactgggtttcaccatgttggtcaggctggttttgaactcctgaccttgtgatccacccgcttcggcctaccaaagtcctgggattacaggtgtgagccaccgcgcctggccacgaagtggtatcttaatacagttttaattctcattgttctgatggctaataattttgatcattgtcttatgtgctcattggccattcatatattttcatttgtaaagtgtctgctgagtcctttgaccattttctatagatagcttgtcttttgattatttagttataagacttctttataaatcttgggcagacatatgtattgggaatatctggttgcaatctgtacctagcctttccattttttcaatactgtcttcttgaagagcagactattttaagtttgatgaagttcaattttgcattttttcttttatagttaataccactgtcttctgttttaaattttttgccggtctcatgtttgcaaagttattcttctagaaattttatggttttgtttaagtccatgatctatttctaatgaaattttgtatatgatctattttatgaatgaaggcttagtgttttcttcacgtggatatcaagttgtcccagcaaatttgttatatgctttcctttcctcatggactagctctcgtgtctctgttgaaaatcaattgatgatgacaaatctcttgaaaatgagttgatgatatatgtgtgagtcaaatttaccccatcaatctctttttctcttcctacaccaataccacagggcctttattcctatggctttatagtaaatcttggaatcagatagtataagtccttaaactttatactttttcaaaatcattttgtatcttatatgttctttgcatttccagataaattttatgttcaggtatcaatttatatgacaatttatatggcaaataatgaatatcatacagtattgagttttctgattcataaactatatctctccatttaattagctttctttaatttctctcagtaatattttgctatttttcatgtagcagatttgcacaacttttactaaatttattaccaatagttttatgctattttgatgcttttgtatgtggtagttttaaattttttattttcaacttttcattgctagcgtatagacaaaaattgatttttgtgtattgatgatgctcagttcatcatcagttattagatctggtcctttatttgtaaaccccgtagtgttttcttcatgtcatatcttctgcaaataacaacagtgttacttcctttatatctttttgtcttttaattattttgcttgctttagtgtcctggctaggacatctagcatcatgttaagtagaaatagtgatagccaataaggcttttttgttgttgtttctctgttaatttttttatgcccatatcacatttccactcttttcccccctctatagataattttttcttttctttttttttaaaaagttctgggatacatgtgcagaatgtgcaggtttgttaacataggtatacatgtgccatggtggtttgctgcacccatcaacctgtcatctaggttttaagccctacaagcattaggtatttgtcccaatgctctcccggtaaagaatatttaggttgtttccaacttccaacttctcatcagcattacaattgcttgtaatgagcattcttgtagacttcaaatgaggatatttccaattagaaagacgaggtttccatttggtatcattaaaaatctcgggaacaagatagcagtgatgtttacccaacattgtgagtgcacttaacactactgaattctacactttaaaatggtatattgtatgtcatgtatgtttaacatgacaagaaagataactgatatgttaaatgtgtgaaaataattttttctcttaagtagttcagttttgtttacattattgatttgcttagtcaaactcatcctcatagagaatacaaaagtaatcttgcccaggccaggcatggtggctcatgcctataatcccagcactttgggaggctgaggtgggtggatcacctgagcttaggagtttaagaccagcctggccaacatggcaaaaacccatctctaataaaaattcaaaaaaaagtaaccaggtgtggtggtgcctgcctgtggtctcagctactcaggaggctgaggtgggaggatcacttgagcctgggaaatggaggttgcattgagctgggatcacaccactgcactccaatctgggtgacagagtgagaccctgtttcaaaaaacagaaagtaaaccagcccagatttttgctaaattcataaggttctactaatgaagctgtagaatgtaactgaagaatcattaaggagactgagtctagccagttccacccatgtcaataaaaagagcctcagtgacttttttcaaactgtaataactcatttatttttctttatatatttatatatcaaactataataaattatatatatatatatatatagagagagagagagagagagagagcaacttttatgtttctgcattgaaatattttagtgcttcaatgtgtggagtggaaaattgccttcagagaaacaggctctaaatttgaagagtcacatttgacctatattttgtataggtgtgatggtgtgtatattgaccatcaatatcatactttgacacaaattcctgaggaattagtgcattcgagtcagtagagctgtctgtgctaaagtgtgcaggtctcactgaggaactgagaacgcatctgagtttcaaagaaagaggtgtttgaatacatttgagttttcaaagaaaagagtgtttgccagaatggatgaaggaggttgctccaaatgtgggaagcagccagcgtgcctgaagcagaatcagggaaagaaaagtgtgtggggcagtcagaaggaatatatggttagtatatataagggacatacagcgatggtggatgaaaacaaaccagtaaggaaaaaacaagtggaatattgatgtcaatttgctgaattcaatcagcataattttaacatttaattaatatagtaagacctagacaatgaatggactttgtcatatgaatgttatagagttttagaaataacgtttggtacatcgaattaacttacacaatcaattcaaaaagcacatgtatatcttcaggagtgccatataatcagacaaatacaacttaattaagatttgtgattttattagtcaaagaaaaaaacattagggaaggattcacctaatcctaattgcatgttttatttagagtaggtaaatggaacagatctttattttccaaaatttcctagtatgaaatccactctgcaaatgtcataacaatccatatgactttaccagagagtagctgaaatagtggtacatactggctgataaaattagatactggattaaaatagatatttttattaataaaatcctaattcccttaacaatgttattcatagtagcctctaagtacattttgaaaatagttgtgtataggtgaattaactactttacatatccagaatctagactcttgtaacctattgcaaggaatctacaaattcatagctcttgtactcctgggatttacaacctactggtgtaaaaatcctgctgtaagagaggtgcatattcaaacaattttgtattaattgtttggaatgattgctttgataggtaggtcatcaatctacaatacttatgctcacaataattatccgaagttatctcctactgctgcctggatctcaactgagagataaactaatttctcttcattctttatatgaaacatgagtatgctgagctatatctcatctgaggccccttctagttctaattattatataattttatgcaatgaaaagttaaactaaagttatggttgttagcgtatgtctcataatatgccttggttcagggttcttcctagaaataacctctaaatcaaggattatcacattcaagaagttcagtgggaaggtgaggccaagaacactatgcggggagtgggaattaaaatgtattagtccttgttcttcaagaaacagacaccatgttgggaataaacatgaaaggacttgattagggaaaatacctgtgtggggaaaaaaaacagagtgcctgggatgttagcagattaaaactttaagtctgctcccagtggaaggaaatatgcttgggtgacttctagggtatgaaaaagttcttcaggaagtccttgaaccagagctggctaccagcaaggtcccacacctgccagggcgaggcctgcgctagtatccctgccatactcccgttattggctaggagtaggaaggtgtgattgcacgcaaacgctgccatggattccaaagcacagcagcagaggccttcattgttcctctctaggtacttggagttcttccagggcgttaccgtgactaccctatgagatatggaaggtaagggaagccaatacaggatgtgctgttaatcaagtgaccagtgtgggccctgggaaatcagaaagacagggtggaacatgtgcctcaaagttatcctatcttagggttgagggctggggtatttatctgccaagtcccactggtgagttctctagggctgtgggtggggacaaacattccatgaaacccccaggctgccatacacccagacaggctgcagcaaaagccctcaggcagctaacgtaggtgcttgcaattgaaagtcaggctggtgggcacagatacagccagtgccaagaggatatgggcaggaccccaacagagtctgctgcaatgcatgggaaagatggtggcaatgtcaatggaggtccatatggtccctctccgcagttcttcctccagcatcaatgccatttggaataatcttccaaagacagagcacagtcaggattagttatgtgtagatgttttaacagtaaaaatactatgggcttcacctacccctggctgttgactttttcaaagtagtgcagaaatcttaggacagcctcctgccaaagagttacatttattcctatcactgcccactgcaaggctttaatagcccttttctctttctttatgagatgcattgaaaagactatctaaaagctaaataattaggaaagaatatcaacaggaaagacctaatagactggaaggtaggaaacaaagcacaggacgattaaatttttaaaacacagcagagctagcattccaataagccctaggaagcctagcgagctttcacggagtacactccaggggcagatagtgggtatgatggtataggtctccacagaagaagatatgtagaacagtcttctgattggtgggaattgtttgccaaaggcaatcttgaactatttcacagctagcctggggttatgtaatcaatggtctttcatagcggcagaaagtgccaaagcaaccaaaattccaagttcaactggatttacttgcatttacttactttacatgatgtgcctacaaatatacaactatcaatcataggtcccaggaatgtagcacttttgcagtatgtatctagagttactggcaattggttcatgacattattgggttcaggacattccagaattgccctagatgccaaggtgtcaattatgtacttggtatgagtgttgggcagaaacatcacctctattgaaagctcaaaatgcattcagaaaatattgatgaatgctaatactaacttaattgtggaagtgttaggtgttcatcataggaaaaccttcattatcatggatacttttctctcagtcctgcctctagattgatgagaaagaatgatctacaataaattcaattcatgcttctcccggatacagggttaaatgtgagacagcagcattttagttgcattaaaaatgtccccagttattgcttcggcctccctctgctgtaaaggctggatatgagtttgcatagcaagtagctaaacttaaactttcccactcttctgaaagatggatagaaagtttaaccagtaaaaatataatgcacaaaaggtaagttcatttttagtgccttgcagcctgcttagttggtgtaaagaatggactactgaaagatagtaaaagcagcgaacttaaaattttactatgagaaacatgaaattgtcaccgaaatttaatttaaaaactcacagaattgttggcataacagtgacttacagcttattcatcagagcaagttagcagaaacccaaatgctattctcagatatccattcttttctcagatattgacttgcgtgtttttacattcctaatgaaattttttaaaagcaacatgtgtagttgtcaagcaagctaaattggtagccaaatgaacccaacgacgtgaggctgcattacattttgtaaatcctaagtcatattcaacttgttctatatactgatttccttattcctgttaggaaaggaagttgaaagtttagacttgtccagatttcagctttgaggattcctctgtcacatgaggcttggggtggtctgcgtttgtttcagcttaagagccatagcaaagatgcttgggggtgttgaaagcaacagctacattgcggagaagcgaggacagaactcacaggtgtccagaaggagagtgagctgtgggagagagcctgggaatgggcagcgatggaggaaaggagaaatgttgaggacccctcacctcccttgtactttgtttcttgaagcctaacgttttgtaatctattgtgttgtcttgatcatccaggatgaaaaatggatctctaatgaatacaatcatatctgtaagctacagattttactatcaacaatatgatctattagtaaagctggccacatgacactgaatttactggccttcgtattaatcatataaaatagtgaagggagttatagtaggctgattctgagatggctctctgtgatctcattggaagagagatgtttattatgatatggcaaaagcctagtgctaatgtggtctgcagttatgctgaaaacagaagatatacctgatagacttggctacatggctaaggagatttccaggcagtggggaagatactatttttctcttgctgcttatagcatgatagaagagccataaagtgagggaagaataaaacaggagagcataaggtcaaaaaaagatacattaaggacatctggctttaactccaatgtgtaaagttcttaaaagtcattgcttccactcttaccacaagaagaacctgagtgaactgaaaatcagtgacaattcatgtatccaaatgagaatgaagttcctacagcaaacagccacccagaaatctgcaaagatagatgaattaggggagtcacagctgagatctgtttacctggtgcagaaaccactagaaacaaactcttggtagcacttcagtggcaatgcttatgattttccggagcactagtgtggagtcgcgtgagagtgataaactcctggggtcacactcttggaatcccacacagttgtggattttacctccagaagccccaccaagctctcacagtaaagagttgagaaaatgccatcatggtcatgtggggcgcatggaagagaagttattgtgaaatatacccagaatattctccatgacaaagacctaccctccagcgagggataaaacctttagcagagacttatcccacttgagggaaggtcacttttcttactctggacaccaatatccttcctgttccttgtaaggggagaagcaaagctaagaaatgcttgtaagggacatagaccccctaaaagactgtgatgtaatcataagagtatagaatacttcccctatgccaaccttctcaccacactaacagggctccaatgtaactgtggattacacctaaaagagccagaaaacacagactctctgtggaggcgtatataaggatgcccaaagtcaagagtggagacaagataaggatactagaggaatttgaagccaccgctacctacatctacagcaaacattatatatagcttgattcccagccagattaataataacaacaaaaaatgctcactaaaggcctgtttgcctcactgattactattcaatacattatgtatgggttttaatggaaaattttaaggtatcccaaaaggcaagaaaaagcaagtcagaaagacaaagcaagcatcagaaccagactcagatttgacacaaatttggaaattatcagatagagaatttaaaataactatgttttagattttaaagactctaatggaggaaatagtcaacatgcaaaaatagatgtgtaatgtaagaagagtgatggcaactctaggaaacaatcaaaaggaaatgctagaaataataaaaatcactgacataaataaagaatgtcttcaatagtttcatcaacagaacaagtttgaggaaagaatgagtaagcttgaagataagtcaacagaaataatttcgaaagtataatatacatctatttggaataccagaaggagaagaacaagaacaagaaactaaagaaatatttgaagtaacactgtcagaggattttcccaaattaaccacagcaaatcacaagtcaagaagtagagaacagtaaacaggagaaataccaaaacaattatacacaaacttcagaaaaccaaagacaaaaagaaaatcttcaaaggagtcagagaaaaagtaacctgacttacagcaaaacaggacaagaattaaattagacttcccatcagaaacacagaagcaagaagactggagtgaagtatttaaatgctaaaataaagaaaaaaatacaaacttgagaaataaagacttcctcagacaaatgctgagggaaataatcaccatcagaccttccctgtaagaaaatattaaaagaagttcctcacggaaaaggaaggtgataaaggtcagaaactcaaatctgcgtaacaaaggaagagtgccaaagaaggaataaataaaggtaaaagaaaatcttttttttcttttcttattcttaattgatctaaaaataactatttaaagtaataatacgatgatggtatcatatgatgagtgaagtgaatgacagcaatgatggtggcatagtgtcatttaaaggtggagttagattacttaaaatgtatgttggaaactcaggctaccattaaaatatttttatttttatattttttttgagttgtagtctcactctgtcacccaggctggagtgcagtgatgtgatcatggctcactgcaagctcctcctcctgggttcaagtgattctcctgcctcagcctcccatgtagctgggattacaggcacctgccatcatgcctggctaatttttgtatttttatagagatggggtttcaccatgttggctaggctggccttgaactcctgacctcaggtgatccgcctgcctcagcctcccaaagtgctgggattataggcatgagtcactgtgcctggccttaaaatatttttaaaatatgtataattaatatgctaaaaaagaagataaaattgtgcaaaatgtcctattaaaatcagaaaaggcagaaaagtaggaaaagtaaaaaataaagaacaattatagcaaatagaaaacagtttaaatatggtggatattaacctaataatatcaatagtcattttaaatctaaatggtgtaaagaagccaatttgaagacaaaggtgttcatagtggtaaaaaaatccaactatatttaatctacaggaaactcattagaaatatacagacataggtcaaaagtaaaggttttaagaaatataaatcttgttaacactaatttttaaaattgcatagaactttattagctgtgaacaaagaagatagcagagcaagaaaaattacaagggaaaagaggtgcattacataacgataaagggatcaattctcaaaaaagacaacaatcttaaacatttattcacctaacaacagagcaaaaacacctaaaaatgatgcaaaagctgatggaactaaagggagaaatatacaaattcaccattgcagttggagacttcaaacttctttttcagtaattcatagctcagcaggtagaaaatcagtgaatacagttgacttgaggaacactatcaatcaatatgatataattgacatttatataataaaatactacctacaaacagcataacatatgttcttcccaagcttctatagaacatacagcaagataggtcacattctgggccataaaacacataggaacaaatgtagaacaataaaaattataggaaatatattatcaggtcacagtggaattaaactagaaatcgggaacagaaaagtagctagacaatcccaaatatttggagattgtcttaactggtttagtgtagctataaaagaatacatgaagctggataatttatgaagaaaagaggtttatttggctcacagttctataggctatacgagatgcatcgtgccaccattttcctggagcccttcaggaagcttccactcatggcagaaggtgaagggcagccagcatgttcagtgatcacatggtgagagagaaggcaagagagagaagagggaggggtcaggctctatttaacatccagcttttgtgggaacaaatggagtgagaacgtgctcatccactcaccaagggagggcattactctattcaggagagatccacctccaagacccaaatgcctcccatgaagccccatctccaacactgggatcaaatttgaatgtgagattttgaggcaacaatcatttaacctatagcagagattaaataacacaattctaaatatcgcatgatctaaataagtaggctcaagagaaatataaatattttgaattaaagaaaaatgaaaatgcaatttatcaaaatttgtaggatgcaatgaaagcagtgcttagacagaaattaatagtattactgaatatataagagaagaagaaagatccaaagttgattatttgaagttatagaagaaaagcataaaaaaattagagcagaaattgataacatctaaaacaggaaaacaattgagaaaatcaaagaaatgaaatgctgttctttaaaaaatcaataaaattaattgataaatctctagttaaggtaaccaagaaaaaaataaatgtactacaaattgacaatatcagaaatgaaaacagggtcatagctactgatgctatggacataaaaagaaatatgcaaaaatactagaaacaactctgcatgcccacaaatttgatggctgagatcactggtccccagcatttttgacactagggactggttttgtggaagataatttttccctgcacaggaaggtggtgcggtgggaaggttttgggatgaaactgttccacctcagatcatcatgcattggttaggttcttataaggagcatgcaacctagatcccttgcatgcaggcagttcacaatagggcttgcgctcctatgagaatttgatgggagggggagctcaggcggtaatgctcactcacccactactcacctcctgctgtgtggcccttttactaacaggccatggattggtacctgtccattgctcaagggttgaggacctctggcttagatgaaatgcaccaattccatgaaatagaccaacttgtacaagaagaaatggattatcttgacaggtgtatttgtattaaagacactgaacataactaataaccttccaaaaagaaaacagcaggcccaaatggtttcattagaaattttgtttttgtttcttttttttttcttttttttgagatggagtcttgtcctgtgacccagactggagtgcaatggtacaatcacagctcactgcaagctccgcctcccaggttcaagtgattctcctgcctcagcctcccgagtagctgagattataggcacccatcatcactcctggcttatttttgtatttttagtagagaccgggttttgccatgttggtcaggctggtctcgaactcctgacctcaagtgatccacccgcctcagcctcccaaagtgctgggattataggcgtcagccaccatgcccggcctcattagaaaattctgccaagtattttaaaaagactcaaccaaatcctctataatatcttccagataataaaaacagaaagagcagcaagtggaatttattctaggaatgtatgactggtttaacatttaaaaattaattactctaaggctgggcatagtggctcacgcctgttatcccagcactttgggaggctgaggcaggtagattacctgaggttggagtttgagaccagcctggccaacatggtgaaaccctgtctctactaaaaatacaaaaaaaaaaaaaaaattagctgtgtgtggtggtgcgcgcctgtagtaccagctactcaggaggctgagtcaggagaattgtttgaacgtgggaggcggaggttgcagtgagctgagatctcaccactgcactccagcctgggtgacagagtgaaactcaatctcaaaaataaaaaaagattcactctaatacgctacatcaacaagttagagaaaacaaaatatatcatcataccaatagatgtggagaaagcatttgataaaaaccagcacccattaatgataaaaactttcagaaaattaggaatagagggggacttccacaaattggtaaagaacatctacaaaaacctacagctaacatgacagctaatggccagacactggatgctttccctttaagacaaagagcaagacaagttgcttcttctcaccactcctattcaacatcatacaggaatttctagcttgtgcaataaaacaggaaaatgaacaaatatataacagattggaaggaagaataaaaactgtctttttttaagcagataacatgactgtctatcaagaaagttccaaagattctactttgaaaaagtcaacaaaatgggcattctgaaaataatttgtagtataacaaatttacaggatacacaatcatgtgtatatagtattatatgaatacataatttgtattgttactatatgtataatttgcaccattactatacatatagtagtatagcaaagttacaggatacacactgtctctctctctatatatatacaaatatttgtatttgtattgttactatatatagtattatacataaattttgtattattatatgtttgcataatttgtatgttactatgtatttttaaatttttttattgttgctgtagtaaactaccataggactagtgttttaaaacagaatgaattcattgttacagttacagaagtcagaagcccaaatacagtctgcctgaaccaaagccagggtcagcaaggttcctttccactgcttttgccaacttctagaggccacctgtattccttggttcatggcccctctcttcatcatcaaatgatcagcatagctttatgacatcagcagctctgattttgctctcttgccttcctcttatgtagacccttgtaattacattgggtacacccagataaccccaaataatctccctatctcaagattcttaatgtaattatatcgggaaagtcccttttgtcataaaagataacatagcaacggattccaaggattagtatgtgagtttcttttgaggggctataattaaccctaccacaatatagaaatgtctattgtttttctatataccagaaataagacattaggatgtgaaattaataacataacaccacttgcggtatcaccaaaaataaaataactaggcatacatatggaaaaatgtgaacaggaactatgtgcagaaaactataaaactcaggtgaaagaaatcaaagtaaagctcaatatcgagaatgatagtccatgttcatgaatgggaacactcaataatattaagatgtcaattatcccagactttgtctacagatttactggaattacaatccaaatctctgcaagtccttttgtagatatcaacaaacagaagctaaaatataagggaaggacaaagaccttcctagaattggcctagaatagtcaatacactactgaagaagaacaaagttgagcccttttattaccaaatttcaagactcactataaagctataataatcaagacagcatgtatttaaaagaataggtagataggtcaatgaaacagaattgagagcccagaaattaatctatgcagagtctgctgatctttaacaaaggaacaaaggcaagtcaatgaaaaaaaaaagtcttttcaaaaatggggctggaataattggacacacatgtaccaaaaaaaaaaaaaaccccagacacaaaccttatacctttcacgaaaattaactgaaaacttatcagggccctaattataaaatacaaaatgataaaacttctagaagtaaacataagagaaaatctagggttttgtgataaagtttttgatagaacagcaaaatcatgatccatgaaagaaaaaattcatacgttgtacaatattttaaaattaaaaacatctactctgtgaaagatacttttaaaagaatcatggatggagctggaggacattatgctaagtgaaataagccaggtaccaaaaaacaaatattgtataatctcatttatatgtggaatctaaaagaaattgatctcatagaaacagaacgaaaaaaggtagttactggggctaaaaacgaaggagagaaatgggaaaggagaagatatggatcaaagggtaccaagtctcccttagactggagaaataaatttaagtgatctattgcactgcatgatggccacacctgataataacatgttgcatatttcaaaatcactaaaagaatagatttttaacattctcaacacacacacacaatgttaagttggtgagatgatgaatgtgttaattagcttgattaaatctttctacaatgtatatatatgtaggtcaaaacatcacattttaacccataaatatacacaattggctaatttaaataaaagcaaggggaagaatcgaaagataagccacagaccagaaaatatttgcaaaatacaaatttgcttaattacttgtaccccaaatatatatttaataaacagctcttaaaactcaacaataagaaaacaactccaatataaaatcgacaaaatatctgaacagacacctcaccaaagcagatacacagatggtaaataaacataagaagatttgctgaacatcattggtgactagggattttcaaattaaaacggcaatgaggcggggcctggtggttcacgcctgtaatcccagcattttgggaggccaaggcagatggatcacttgaggtcaggagttcgagaccagcctggccaacatggtgaaatcctgtctctactaaaaatacaaacaattagccggacatggtggtgcatgcctgtagccccagctactcaggaggctaaggcaggagaatcgcttgaacccaagaggcagaggttgcagtgagctgagattgtaccactgcactccagtctagttgacaagagcaaaactccatctcaaaacaaacaaacaaacaacaacaacaaaacagcaatgaggtactattacacactaattagaaaggcgaaaacgcaaaaacaagctggagataccaacgactggggaggaagcagagcaataggagctctcactcattgtttatgggaaggcaaaatgacatggtcaactttggaaggcagtttcatggtttcttaaaaagctaaacatactttcaccatatgatccagcaatcactttcctagatatctacccaaaggagttgaaaccttacatccacacaaaaaatctgcatgcaaaagtttacagaaggctgattcacaatcaataaaaactagaagtaaccaagatgttctacaatatgtgaatggataaggaaagtgtggtgtagccatagaatgaaatattgtttagtaataaaaggaaatgagctattaagccagaaaatagatggatgaatcttaaatgcatgttgttaattgaaggaagcccatctgaaaagactgcatactgtatgatttccattatatgacattctgaaaatggcaaaaacagtgatcataaaaatcaccattttcaggggttggggagtgaataggtgaagctcagaacttttagggtggtgaaactattttgtatgacacaatgtggatgcattacactgaggataaaaagtaaatcttaatgtatgtaaatttaaaatagtatttaggaggccagggaatcctagaatggaatgcagaatgtgacaaaaccaactttattaaaaatgcattacacaacctcactgaagagggagggaaaaaggtgctgacataagcaactttggaaatgagtctgtaagacacagtgaaaagaaactgtacacagcactgccactgcattctagttaataacactgtttcccactggctacaggttaaacgttctgataccactgtacctatagagtagaactgaacaacgaattggatggttggtggaaggcaggagccagatttaccactgttggagtgggcatttacagataagtaagggaaaagggctggaatgattcgtgtggcaacggattagagttgtagacattagtatgaattaatatttggctgaatatagacatacactgttaaatatagaaatatttatagatatttgtgtatgacctggattagtatatacaaatacattaccattctctgtcagctagaggactcagaaacagtatcacagtagcaatgagcactagtaatgcccagacattcgtttctaataccattgtctaataaaaataaccagggctccttggagaagtggctgattctagtgacaggaaatgtacaagatgagcctgaggcaccttgtagtgccataaaggaaatattccaatcgcatgctcgtgcaggcgcacacacacacacacacacacacacacacacacacacacactaatgggggtgtggccaaaggtgcacagagccactgaagatcacccagtggccaaagctggcataatgtgagcaaaaataaataagagtagtattgaattataacccaaaatatcatacaaatattcataaacccatgctttatagttaaataataaataaatgaatgggtgagaagagacagatctcccgtagagcagaatgttaaaaatgtatgcaaacgctctgccctcaaggaggtggaacaccactcctcactccttcagtgtaggctgcatgtagacgcctccttacaaagagtacagtatgcaaatgagaaaggataatagtaattttactgtggagaaacttgacaaatactccctcaggccaggaaatcccaacctttgcctggctggatttcagaattgctttagagcagcaaatcctttgtgcctccagttctctctttatggaacaggtgtgcctacacctgttatctaatgtccatcccaccattgtatgttgaatacatgtgagaaactatcttatctcttaacttttacatatctaaacatggaggaaagctatacacaggaagtacacccgaggagcctccttcacacatgaaactgtttctgatgatagaattctagactttgagctgatgctgtaatggaatgacttttggcgatcttgaaagaaagtgagtgtatttcacatggggagaaacacaaatcattggaggccagagggctgattgtggaaggctgctcctgacaaggcttccaacaatcccatccacctggcattcacattcttgcaaaatctcctccacttgagtgtgggatgaacctagtgacttgcatctaatcaattgaataaagcataagtggtgaactgtcacttccaagatcaggttatacatgattgtgatttccatcttgcttgtactctctggctcttcttgagtacttgccctgatgacactggctggtgacactcacatggcaagaaaatgaaagtatcctctgaccagtggcaagaaagaacggcagccctcgctctagaggcctttgaggaactgaattctgccaagagccacacgagttaacttagaagcagatccttccctagtagagccttctgatgagactacagccccagatgaaaaattcattgctatctagtgagataccctgaagcagaggacagagctaagccatgcctggattcaagatcctcagaaactgagacaatagatgtgctttgtttaaaaccttcatgttttcaaattatggatggtccccaacttattgtactttgatttacaattttttgactttataatggatttatcatgctgtaactcgttagttcaggaacatctggacttatgatgggtttatcatgttgtaactccattgtaagtcaagtagcatctctatttgctatgcaataatagatacctaaggagtttaaaaattgtactaacgtcttgggaaatgatttggcagtttctaaaaacaaacaaacaaacaaacaaaaaaacaaccctgcatctaccttaggatctaataattccacttccacatatcaatacatgataaatgaaagtgtgagttcacaaagaaaaaccctgtacatgaacatttaaagcagcttgatccataaatagtcaaaaactagaattaacacatgtaatcatttgtaagagaatggataaattaataatggtacatccatacaatagaatattatttaacaataaaaaatgaactgctgagacatgcaaaaacatgatggacctcataaacattgcattcagtgagggagttcataatgcatgacttcatttatttgaaattctagaataagcaaagctagtctatggtgaaaaaatccaaacagttgttgattatgggggtagtttattgtgaagaaacatcctttggggggtgatggcaatgttacctgtcttaacaggggtatggattatacaaatatacataactgtcaaaactgatctgttcattttactatacattataccacaattttttttaaaaaaggagatggcataaaagaaagcaaaggaaaacatagtgaaaccccaaattcacaatgcaggaaatttcaggaagaaaactattcgtgccatggaagaaaaaattgctgttattttactaaatcataactgattacatcaaagtcaaacatattgtcacataagtgacataaaatcaattagacatcaatagcatgtttcttatctttttctgtgcaaagtgttcaagcttgattaatgaaatgtctttcctaacgcgagggtgagtcatcaagctcgagatcatgatgagctcctctcagggccactgctcagcctgctcccttcaatccatctcaagggccctctcttctactataatggagctcacagtcaaagtgggagaaggaaaatacacaagtaatcacagataaatgcatgagtagttgttagccagaaaattggaattgagcaatagtgtctgtaaattaatgtgaagtgctagcaattgttgcaggtagttggtagtaacagctgatgaacacctactactatgcgaagcacctgctgcacattagtatttctgagcctcagtttcctcacgtggaaaggtgcagctataacaccgaccttacaaatgtaagaataaatgagagaaataatttgcccaaggatgtgcactaggaggtggcaaagccaagattccaaccagcatctgcatctacagccaagctctgcattacgctgatctccaagctgagccttcatattcatctcaggagtgacttttgaatgtcttcagcagccaaaagcaaccaaacacaataatttgttttacaaaatggtgattattccaacttggaattgggaacattaaagaaatgaccatgaatatcagcaaataacggaagaactaaaataaatctcccttttacttttaaatggacaatgtaaggggatgtacttttttttttttttttttttttggagacggagtctctctctgtcgcccaggctggagtgcagtggtgccatctcggctcactgcaagctccgcctcccgggttcacgccattctctcgcctcagcctcccgagtagctaggactaccggcacccgccaccacgcctggctaattttgtttttgtatttttagtagagacggggtttcactgtgttagccaggatggtctcgatctcctgacctcatgatctgccctcctcggcttcccaaagtgctgggattacaggcatgagccaccgtgcccggccaaggggatgtacttctgttaccaagccaacgcacttgaggaagaaagttcagctctggtcctcataaattagtctaacttcttccttcaatttatacaggctaaaaccaagattttgggatggtgaaatagaaaccaaattatgtggtttgattcccattcagaatattcaaactcaactatatctgcctggataaaatttaacattttgtcaaataatatggctgtattctaacgtgcccttggtcccctgttcagacttgtgatcctagaatgttgcaatgcagtcttcatgaagcagctgctcttttttgactgatttttcctggttccctggggtcaatttcttttcacctgtgtctaaatgccgactaattagatcatgacttcacaggtgccaaaagaaaaagaaagaaagaaagaaaaactcttgggaagctgcagagacttctattgcagaaaggaatggatgtactctgttgcccttccccaaataccgccctggtcaagccaattgggccgccaaccaatggcaccgaccgggcctccgcgcgcagcgcctgcccaattgacagagcgctcgcatccctcagctgtagctcgtgcagcctgtgctaacgagcccgggtgccgtcccagctcctcctccgcccactccactgtctctctttcgcctgtgcagtggttcctggcaaaacctcttatgccacctcccgaccatcccgggaagatttggcggctggagccctgcgcaggagctgtaggcaagagtgggcgccagtccctccttaacccctgctgggtgggtggggtgccggagtccgcactgatgaccgctccagcctgagcttttgagggtgaggggggtgtggaaagatccgccctggagcgagcgcgcacccgtgggctccttgcagcggtggctctgcctggtggcgcgagggcgtgagtgcgcgcgactccctggctttcgcgggtttccccaccccttgcgcaggaaagagcctagtcctgcgtccccctggctctccccacacacacctccttggagctccttttgggtttgctcccgcttctggtcttgagcgtcctgaactgtttcccggggaggcagcactgggcagagcgccctcggagccgctggcgccggcccggcttccctccggggtcccagcagctgcttctccttctccagctctgggctgcggattttaccgcccctgcacagaagcctgcagcgtggaggctcccctcgcgctcgcccagactcggctgcagaaggaggacccacctcgcgtctcccccgaggcgcgcacctctgtcgccaccctccacgcgcctaggaagttttgaaggtagagaatctgggcccctcaacttcctctggacatgaatcaaaccgcaggagtctccaatagcgtcaggtgtcccccggggaaaggccacaaggtaagggaccagcgacggagggggcttgtgcgggggcgtggggcgcagatggaggctacagttggccggagagtggagactccggcaggtttgtggagggagtgtgagcagccgctggtgcgtctgcatgccttgcaggggtcggtgactgaggatggttggcggatcgcgggggttgagagaacgtgtgctgttttgtagacccgcggccagcagcagggctctgcccgtgcatccgctcccgccggccaccctggggctggagatcctaccctgctttgcggctgggctggcaggtgcagctgtttcccatgattgcgaggctttcgggagaagaggtcggcgttgggaggcagagcccctccccctttcacaatcagacccccctgggccagagcttgcagaggagctctttcccgggaagcgcgcgcggggctctcccgcgggcgctggcgctggctgctgtcacggacacgtgcttcattaactttaatggagcgatgcgtgcctggaattatttccaggaaattagtgacgttcagagaaaggggagtgggcggcggcctaaggaattctggcagaacctcactagcagcccagagtgtgagggacttgggaaacgtttactcccacgcgcaaaaaacccagatcgccagcgaggttccggatttcgcacggatcctgtggggcccggccacccttggccatgctcaatacgcctcacctgtctgccattccgcttaggttgtgatgaattagcgaggaaattccttacccgggttacatagggaagccgcacagcaatgcatgtaacaatgaactttaaaatattttcgaatatttatatatttttttaaatcgaaaaaaggcgagcactgtggagcttagtccttgatatgcagactgaatttatgctttactctgtcatcttattttcgacacctatttttgtgtgtacactttatgtaagggcatatatgtttattagctcttattggaaaaatattcccattaaaatctacttgttggggtttggggcatgtattagcccacaatatcaactccaaacactatctacttgttcggagttgaagtgagtaatgatattggattcacttggcagataaaggaattcttgttctgtttgagttatgtaagatgaggatttaaggttgaatgcttttattcaactgagtaagtaatatcgagcattttcttctatcagatcatgaagaaatatttgaatcagcaagtcatttctctgatctctgttctcactatgatttgagtagttatatgtttcacatttacattacttaatatctacaggaaatgtattttaatacagagtagttgatataaaatttttcaattaaaaataaagtttcacccatcagtgataatatagtagagacatctgtggagttcagaagatcattcaggaattttctttaagaaatgtctttggctccagtattaaagtggcttcttggaagaattggactgtagagtattgccaccaataaaactttctggaaagtgttggaacacacaccaacaatttaaaaggtactaggaaacctgttaatcatgagttagggatcaccttacatacctatcaggtgtccaacaaatacttgctccaatgaatcatattaattcaatagtcatcaatcatccatttaataaacatggtaaacccctattaagttccaataatatgagaacggagagccgcaatatgaacttagacattgccttcactgtccaacatgcagttctagtcataccctatccttccttctttaaaatctttgatggcctaaagtgagatgatggtgaaatccattagctagaaggaaaaaaaatattcagttccttttctcaaagaagaacacacttaagttgttgtttgcctgtaaagtttgcagctttggagtttgtcttgtaggttgctgtggtgcgataacatgagagactgaaatgattggaggtgacgtgttggtgaaagttctgtagtggatgagggatgagctggtagcaggagtcaacagtcaacactgggaagtgctggatggaccatgtgacatttaggtcacagtatttttccaataaaatataaaactcaacaatgtcagtttagtagatgttttggaacagttgtttttccatcgtatatatagcatatacgactttggtggaaggaaaggcatcagcctcttaggaaaatattccagctggactcacttttgtttggtctcattcatttactgattactggtgtagcaatttacacttggcaaattcttatcatttgttcttgtgcagatatttcttgagcaacattggttgtctcttttagatggttattcaccttttagatgtgttagccttcttttagatgtgttatttattgctaggttcattcttgcctattgaagccctagaatttggaaagaagaggtccttgttgcagcctcctttctcctgagcatgggggcacctgaccacctgctaacagctgctgaggatcacagggtaatccaccacactgttggccccagtagaggcaggagccactggtcctgagaggaaacctcctgaagtgatagtcctctggaattggctcctggaaacttgtaagtggtattcactcttgagcaaagaatacaaacttaagttttacagaagatgtaaactaccaacataagactgttcaactttagctttggaagatggcactcaccttctgagcagaaagtaaggacacccagttgagtagttaactccagccaaagtagggcctctcctttcagcctcaggtttgaagagaaagcaaaggtttggattgagtttctttgcttagagcttttctgaaagggaaatttccttgtatcagtatgtattacgttagacatcaagacaagtattatcagtgcttcagtctctggaagcagcagacatagctgtccaaaacttggactttgggatcctaaggtaccagtgtcattttggataagttgcttaacctccatgcctaagttttataggaccttcatggtaggagtttcatgaggattcaataaactaatccatgtgtggggctcgcagcaggacctgccacacaagatgaggcattactttacctttgagcacccaaatcagggaggacaaggcaacttcactttaaaaccctttttattaagggggagcatgtgctttataaatatttgtaccacagcctctttttttttttttttgagaccgagtctcgctctgttgccaggctagagtgcagtggcatgatcttggctcactgcatcctccacctcccaggttcaagcgattctcctgcctcagtctcctaagtagctaggattacaggtgcgcaccaccacacccaggtaatttttgtatttttagtagagatggggtttgccatgttggtcaggctggtctcaaactcctggcctaaagcaatccacccacctgggcctcccaaattgctgggattacaggcgtgagccaccatgcccggccaacagcctctttttacatggtcgcctctcataggcacacagctcctcaggagcaggtcccagagggtatgagtaggatgggataattgttagagtatgggctttgcagtgagacaaatggtaacttggtaaagatcacacaaatagagctgggcatggcatggtggtatgtgcctgaggtcctatctactcaggaggctagtgtgagaagatcattgaagttggaatccagtctcggcaacacagtaagatggcatctctaaccctcacccccacaaccccagaaaaaaatcacacaagtagaaagtaacaaatgcaggacataatttaatttatttttacacatctggaaaaggggaatataatgtatgcattatctcatataattgttaagaaaatccccatgtaacagtttgcatatagtaagcatttattacatgacaaagcttcacatcaagcatggatataggtcctggtaataattctttgtattacttatattataatttgagaccccattttatctaaaattcttcgctctatctgatgttgtaattgtttatatttcatatctgttttctcttttctctgctttcaagagtatctccttatctttgattttccatgtttggtgacttgtatgtgactagccatgggttcttttatatttatcctgctaggagttcactaagcatcttgaatctttaattctttcaccatatttggggattttgtaccattattttcaaaaatatttttacattttattctttcttgggatgacaattgtatatatattacacaatatacagattacatattatggcctacaaatgcatatagcatttacaccatttgataattaggatcaatataacagattccatgagcactttttccagcttgtaagattcctttcctagccatttttgccaacaaggaatctagctccaccaggtccgaaaaaactctcaattcagaaacatacttaaagagtaatcgttttgtctgagggtagagatcaaaagtctctgcttcctatttgtgaaggtggatatttaacattctagttttcgttctcattccacctttgtctccaaagccaaaagggatgagttattagtccatgaacctcaacggattctttgcaatgaagagtagatgcaaaactttggctctgtggatttcaatctgaactcaactaacgaaatcccttcaggatcaaggactcacttggtgcctctctgatgaatgcagtgattaataatcgtaatatctcctgtttacccatttgcgctcctagaatgtggcaagaagtcaatccttattcatcatttggcaccattttctggtgaggaacatcgtattctaccaatgaattactaaaatgttggtgtttcttctcaaggttttcatgctgtgaaaaagctgatgaagtgtttgcattttgaagttgcttatgatccatgaagagtgtcagcctctacccacaggagtttgctgacttttgccagctctaggtattacactttgtggaaatttaatagccttcttaccttctacttctagtgtttattttaccacaaggacagggatagcaaagcttgtatgtctgtcattttccttttaggacattaaaaaaaaggattaatcagctaaaaccattttgattcaatagaaatgcatttttttttgtgtgtgaaatactactcatgaatcccacctacatttttactttgatttcatccttaaaggatatattttcctggatgtaaaattctgagttgacagaatttttacttctttttcagcactttaaagatggcattccactgagttctagaatgagttttttctactgagaagtgaagtcatttgattcatagttccctgtatgtactgtattatttttctttgtctgcatttaagatttttctttggttttcaatatttcaatactatgtgcctaggcatgattttcttcatatttattaccgtagtgggtgcaaagatcaccttgaatctttaaatgcaccatctttgggaatttggtggccattatcttgtcaaactttttttcggtcctattcttaatttgttgagatgacaattatgtatgttttatacagcttatattgctttacaggtctctgaggctcatcatttttccaagatacttttctctctctttttcagatttaatttctgtggttccatcttcacatttaatgagtctctcctctgtgttctgcattctgtggtttgtgtgcttagctccggatattgcattttcaaattctaaaatgtccacttagttctttctccataatttctattttctgcttggattgtttttttttttaattcaccgtgagtatctttgctgtttaataaatgaggagtcttcttataatactttaaaactcttgtatgataattctaacatctgagccttcttagaattggtctgtgttgactgtattttcttctcgaaattggaccacagtttaaaatgtccttgtatgttgagtgattttgaattttatcttgggcatcatgcttgttgtggaaactctgcattctgttttgtttctctgatgatttgtttttcattttaatgaacacttaagttggatggcaactcaaatacaagttttgttcttttatcctcttgtagcccattcagcacctgcatgactcaggggacaactagagatttggaggctgcctagttttcttaattctggaatcccttttcactttccaagtgagtcctcttcaagactttaaatctttgtgaagctttcttgttgaccttcactcagtctcttttttattttctgtcagttctttctctactcttctttcattttcccagtgttacattttccaaaactcacattttgataaactatcacttgtcaaatctgaaaaatctgaaggttttcatgccctcccttttttgtcttctcataagaagcaaaacctactttaatgctctccctttgccaaaatacctcctgtctccttttctattctttcctgccccttttggtttagatccatagaccttcccccttctggggcatttcatcctatttccgaacttttcctcagtctatcctgcttaggaattgagcagcctcctcctcctcttcatggcttaaagaatttccctcctggattttagcactgattccctttctgtgctttccactttccaagtgagtcctcttcaagactttatatctttgtgaagctttgttattgaccttcactcagtctcttttttattttctcttctctttctgtaggaagccctccctctaaatgattagatcagccactgactcacaggctatgggacatggcaaactcatgcaaggcttatggcgtttcaccagttgctgccataacagcaggtccttttcctgccccttttcttttctcacacacttggcttcagaaccaccatctatggacatgagtatatcacagaaccagagtcctgctaagaagggaatttttttttaataactcatggttgcaggtaccattctccagcttgattttggacttgaatcagaccctcccacctactctgatccctacacctccctgttcctgagcctgtagttctttctgaattcccaggttccctcatcctgaccattggtatctgtcgttttccacatagtgtctagttcctcctatgctggagaatctttcatccctaatataacatatttaaaattaggatctaactttagaggtaatttcatttagtcctctcatttcaaaaaactgagatccaacaaaacgcagttaatgagagagccagggctcaaacccccactgcctgattctaggttttggcacattccattatacgaggctgttttgtggttcatcttctccatctgagcacgcagtgaagggccacatctgatagacacttgggcatcatgaaggttagtgagtcagcctgaaggacacttcactaacacttgctgttagcaagggcatgtctagttcataacttttcttatccaccattgctcttcattctgaaaagaaagcttagttgtctaattggtaatttctggaagaaataagaaagagtacccgtgtaaatataaataaataaattctttttatcacccaaaacttaaatcatccccaagtatttcagaaagtttaatataatggatagaacataaattacttttatgacttccaggatattactgaaaatctatttatgttattttggctttacattttattgatttttaaaattttaattgtcctcattttatcagtaaaatacataaaatgaatctaagctcatacataagttaagtttccaggaatagagggcagtaaatgagtagtaactgttttttctggttttatttgttggattttttttaagtcaaaagttatacctcaaatgcagtatttcaattatcttacaccttgtacctcatgaaggaaatagagtgattggaattttataggaccctcaaatctaatatttttattacagtcccagcaatatggatttagtcaaaagagatggaggaagttatgtaatttcttgtgcatgccctccctcatctttagggctttagaaagtttgtattattttcctattatggagacataatgtgtctgttctttcagtgtctgtatcttcctttttatgaaaatttcaaatgcaatattaagagatcataaggcatttaggcattatgagacattttaaaattacatctgacaaaatgtgcgcacagcagaacaagttcatatttttcattttgtttttcataaaccaaaaaagctgacaattcactggggcctcgtggaaacttcttaactgtgtgacttcatacagaaaagctcatccagtggcggatggtttactgaggtagagtggaaggagggaaacggaatcagtagactcgatcttagcattggttgagtggggcacctgttttgtgtcaggtgggtgggcaccgctctctgggcctttgttcacctgtgtgaaagctgaggacattcaaccagccttcagggtcacgtcaagctccaacttcacaatattccaagcctagaaagaaccatgggccgggcacggtggttcacacatgtaatcctagcactttgggaggccgaggtaggtggatcatttgagtccacgagttcaagatgagcttggccaacatggcgaaaccccatctctactaaaatacaaaaattagccaggcacggtgtggtgcatgcctgtagtcccaactactctggaggctgaggcaggagaatcgcttgaacccaggaggtagaggttgcagtgagccaagatcgtgccactgcactccagcctgggtgacagaatgagatgttgtctcaaaaaatgtaaagaagaaagaaagaaccataggcagagtgtttgctattattaaggcatccattggcatagatatcaaaaactatcccatagtaaaacatacttaatggagaacctaggccagtagatgtcctttagacttcagtgtaaaaattatgacctccagcaagtcctttagggaaagggtgccttatagttgctaggctagtcttttcagggactcttaattggtgtttgtcatatttagtgagtaagtactaaactcattgcataaagttataaattattgaagtcagctaagtcaagagatggtgtcttaaaagcaggacaaaagaagattattacctcttttgttcttgaaaaagatattgcaaacactggataccatgtttaataagtacattgaggtatagttgactgtgcatatttagaatgtacggtttaataagtattgacgtgtgcacatgtgcatacccgtgaaaacgccacggtcaaggcaatgagcatatgtgccattcccagaaggtgcctcatgctcccttgtgatctgtttctccctaacaattccactacctttttccatccgtaaggaaaaccgatcttttttttctgttactatatattactttccattttctaacattttagataatggaattattaaagtaggtggtcttttatagtctgacaactttcactaagtataattatgttgagatttattcatgttgcagcatgtatcaatagttatttatttgttgccaagtaatacttgattgtatgcctataccatggtttgtgtatctattcacatgttgatggacatctgtgttacttcaaattttgggctattaccaaaaaagcttttataaacatttatgtacaagtttttatatggacatatgcttacacttcacttaggtagggtaaatacctaagagtggaacagcaagatcatacagtaggcatatgttcaactttttaagaaactgttaaattattttccagagtcattttagaattttatatttctacctgcagcttctgaggcttccggttcccccaaatccttgcccacactcaagataatcagtcttcaatatgagccatttaaataagtgtttagtggcatattggtgcagtttaaatttgtattttgcaatggctgatgatgttaagcattttacagatgcttatttccatccacatatcctcttggctaaagggtttctgaaaatccctgacatatttttgattgggttacttggtttctactgagttgagagtttttcataaatgtctttatcagctatatatttgcaaagtttcttccagtctataggggtatatagtctataaataaatctttttttttttttgagacccagtctcgctctgtcacccaggctggagtgcagtggcccaatctcggcccactgcaacttccacctcctgggctcaagcgatcctgaaactgcctcagcctctctagtagctgggactacaggcacgcaccaccacacccagctaattttgtgtgtgtgtgtgtatttttagtagaggtggggtttcaccatgttggcaaggctggtctcaaactcctatcttcaggtgaactgcctgccttggcctccgaagtgctggggttacagctgtgagccaccatgcccagccaacaatgacttttgaagatgcttgcaatgtggataaccatatgtgaaaaaaagaactttgatatatcctaacaccatatgaaaatattaactcgaaatggatcataaataaaaatgttcaatctaaaactagaaaaattctagaagaaaacataaaatacctttaagttaggcaagtgctttttaagtatctatgagtttatccttttcatcaaatttggaaatctgggggcactatttctgcaaatatttccctgcttccacttctctctctctctgtttctgtctctctctctctctctctgtttctgtctctctctctgtctctctctgtttctgtatctctctctctctctctctctctctatctgtatgtgagtgagtgtgttctctgtcaggggtttcaagtgcatgtatattaggctgcttgaagttttaacatatctcaatgatgctttgctcatttttaaatttatcttttccctgggttttattttggattatttttattcttatgtcttcaagttcattaatattaccttctgcaataactagtttgttgtgaatcccacccagtgtattttttgttgtgcgcagtatccatttcctctctaggatttcaatttgggtctttttaatgttgtccatgtcttcattgaacattttgcacatatggaattcagctgtaataattgttttaatgtccacgtccactaatgttaaaagttgcagcagctctgggtcaatttcaattgatcaaatgccatccttgaatgagatttgtattgttttgcttctctgcaagcctggtaatttttgattggatgccagatattgtgaattttatcttgtacatgctggatattcgaatattcctaaacctacttcagagctatttttctggtactcagttaaggcccctggaaataatctgattccttcaggtctagctttaaagatttactgggtggaaatgtaatattaattataattaactatgattataattatccctatgctcagttttagggctaattatccccactacaaaaatagggcccttttgcgtattctatgaaatgtccatgaatcatgagattgtttgagagtggcttatctgagcacgtactattttctgtcctgtgtgagtgtcagggcaccactgcctccaatacttccaggttattctttccccaaccttggagagtttctctcatgcgtgccctgttctgtactcagctaattttcagggggccctcagcagatctccaaagctctctttccgtgttgcttgctcctctttcagaccctttagcgcaaactgtagctgccttgttctccccagactctcagctccatctgtttagctcagagtctcctgggccccacctaggttgtccatcatccgctttagtctgaaaactctctaaggcagtaagctcgggataaatgggactctcctcatttactccccatctatcagaaatcagtgtccttcttcgctttctttgatatccagtgtctcgaaatatgttgtttcctatgtttgtacaagatttatttgtttcaggcaggaggattcatccatttcctgtttctctattttgactagaagtgaaaatctctgggaaaatttgttagtacataccttttgattttagaaatcatgactttaaaataaaatgggcctaaaatgtatgagaaattttaaattaggctaaattttatgctgaatatattgaataagttaaatataactaagacaaacccatactctgcatatctgacatgaattatttgaggtctgaagactggaagacactatgaaatgaaaagcttgtcaacaatttgacatttctttctccatgcttccacttttccaaactttttcatgaatgtcaccttatttcatcttgcaacagccactgaggtaaataggtaagtatttatctccccttttttttgactgaggaaattgtgctacacagttacgtgtgtatcacttatggtcaaaagctaataaaatcaagaaatgttttcaaactaaaaatgtataaatattgaatactattcaatcttttattcagcaagcatcgatccatgcttccttcaacccacgttatctattaatttatccaatgccgaatactatttctatacttcataagcattggactccttgctattattcctttaaaaataactaagaaactattatttttattaatgagtccgtgtgtgcacaaacaaggcagaaaacaacagaataaaatacccagggacactgaaaaggaataaatccaaattgtagcattttggttggtcaggggaaagagtggtcagtgtggtttaggtaggaaaggcttgccaaagataatgggacttattgcttactcttctagttacatgtcctgcagtcatagaaatatgcagactaaagtccgtgtaaaaaacattttccgcttccccacatgataactgtaatcctttgcaactcaagggccctatagggttttaatagacagttattacataacattttctatgtttacttctgttaatttgtatttgtaaccacggagaatagattctaattccctgcaatacaggaactctgaagctttacttcccctttacaatggtcaaaagcctgagaaatcataaagagcaacatgatatgaaaaaataaaaacaataaagcaacttttaatatcttcttccatcctatgtaggcttttgtagtggtgcaacattccttacttaacctattcatcaactgccaattggacatctgtgtaatacaggtgttattcattgcttcccaggccacttatcttctaagggattaagactctacccgcctggcgcggtggctcacgcctataattccagcactttgggaggccaaggcgtgtggatcacctgaggtcaggaattcgagaccagcctgaccaacatggagaaaccctgtctctactaaaaatacaaaaaaaaaaaaaattatctgggcatggtggtgcatgcctgtaatcctagctactcaggaggctgaggcaagggaatcgcttgaccccgggaggtggaggttgcggtgagccaaaatcgtgccatttcatgccagcttgggcaacaggagcgaaactccatctcaaaaaaaataataataaaataaaataaaccccacccacagtctcttctctcctatttgaaacacaggactctgtctcctcctagatacacaccaaggttgaacaagcactcctaggggaataaagccactagttgagccatgccaatcaaatcctctcttttggaaacttgaacaaagacatagagattacaatgagaatttgaaggacgctgtataagatactagactgacagccgtgcatggtcatgagcagcccagggatgaccactgggagaagagaaggcggagagcagcagagatcacagaaatcatgaggccctgaaaagtgaagatcccgccctcactttctcactttcctgatgcagtcatgtgaaatttgtctttacttccatttatttcctttccaactctcagtgttctgaaatgtaccattacgtaaaagtgacagaaaatgaagaaaaaccattaattcctagtgggatttcccatttttactctcactcgccattaccaccaaataaaactgtttttgttgagcaaacttttctataagcctctttgcattcttactttgcatcccaggaggtacaagtaagaaaaaaaaaaaaaaaaaggtcttctgaattcttctgaattattttctaagtagaagtgggagtgatggctattttccaggttagtattggttagagctcaccagaactgaatttgtcagaaaaatagagggtatctatgaggctttgtggcgagagacaaaagggaacaaggaaaaaaagatgttgctggcagccaggagatatactttggggagaagaatggaagtgttactgtattgtatcttgcttttttagaaaagtgtgaatagaaatcttctgggtttactaatgtgttatagagctggatttgggcgttttgtggcaattggagttgcgtagtttacgtaacattgagcagaggtgcaagatgggagagacaagagctcagactgcccaacgggtctcagaaaatgtaggttacatccataatacatttgtttgttgtttttatttgagctactttgtataggcatctattttcttgcaatcaaataagctctaacgaaaatgatgtgtaatgtacaaagtaccttagcagcttcaataagcattagacatgatctccaccctttcatgaattcacctgtgttatatgggtaagttagactccaggaacaatcataaaacagccttattcttttctccagctgtccctttagaacaaaactctgtctagttctaaacagaatcacactgatttttgaagataacatagctttttttctggctcttttgcatcacaaatagtatcatttacaaaattaaaatgcccggcctagtctaatataacattattagcttcaggattcattcagagagaaacttttcctctctctgagcttgagtggctgtgggtctggaaacctgcactggggaagggaagacaggaggcccttctcttggcccccttcctggtatgttccttgctcctcttctgcactcgctagtcctccctggcctgttccttgctcctcctctgcactcagcagtcctccctggcatgttccttgctcctcctctgcactcgccggtcctccctggcatgttcctcgctcctcctctgcactcgccagtcttaatttctcacttctccaaggttgggttcagggggaggagggatgagagaaaggatacagcgtcacatggtggttatggatctcatctggtgatgggtctctctggatgtgacaaatacacaaagccgcactttttctcatggggagcttttggagagcttctttggagaccctcacatagaatgttggaagatggcttttagccttttctctcactgtgatgccttcacacatcctcacacttcctgtctttaccctcttctggtcctttggctctattgggtggagttccttacaaaatggctcttgggattcccccatgtagttcacttctggcttatgagaaacacccacattttcccaccatcaccagaaccgacacagcttgcttccaatacagtcccctctcttcacatggggctgcctgagatttttccaggtggggtctaggtagcattgcttatgcttgaaagactctctgttctccaaagcacccgtttcaggctctgtgacgccgaatggctctgtgacaccttctcctttggcttgtgctgagaggaaacctgtactttccttttcctgacccagttgcacagcccttagtcccttcttcctccacccaaaagatgagggtgccagataattccactcactctctatttggaggtttcctgtggattattgtaaatgtgcgctaaccaatttcataccctttattattttttaaataatgtaacaggtcaccttgggctgcagggacacttggcaaccatttttacagcttttaacttttggtgcccgggccgggtgtggtgtggtggcccatgcctgtaatcccagcactttgggaggccaaggcaggtggatcacctgaggtcaagagttcgagaccagcctggccaatatggtgaaacctgtctctactaaaaatacaaaaaattagccaggcatggtggcgggcacctgtaatccctgctacttggaaggctgaggcaggagaatcccttgaaccagggaggtggaggttgcagtgagccaagatcatgccactgcactccagcctgggcaagaagagcaaaacttcatgtaaaaaaacaaaaaaaaaaaacagaaaaaaacacctaggtagttgatgatgtatgtaaattgtcagtgctatctacattcagggggtatatcaggaggatgtattttggtttatgtgattttaaaaggattcacggcagagttgaggtttcagcagagtagtggaggacacagcttcttatttgagactttgttttacctaaaaaacacatgtcgcctcaccaaagtggaaaaatctcattttctttacacaccgtactgcaattgcttgtgtactcatgcttatggaaagagggaacccttgaatgacttatccttttcacaataaaatcctccccctgttgcaatgcttcttctcaaacatcagtgtccacacaaaccatcttggtgttcttgttaaaatgtggattctgattgagtaggtctagggtggagcccaagattctgcatttcttacaaagctcccaaatggtgctgatgctgctggtcctatgaccacattttgagtggtaaggctccactgcttttgctgagtcatatgtaatgtactaaataatacattttgtcatttatgattgacaaatcagtcgaagcctttcatttcgtgaaaacggtcttagtggtagtttgcacataacagcctctcatttctttgaactggggttagacattttggtgccattcatttggaaaggagacttgaaataggaacaaagagaatgaggttcccgttgtcagctgtgctatcgacttttgctatgtggccattaacaagctttatcatctccaaactttagccacttgcattgagtttttgtattaagtagtctccagaggtctagccaataccaacgttctatttctagatatattttatgtttatcttatctactcagctatatcattaaaaagttgggaactaagtttttgtttgtgcctgtattttcctttctggaacaaacaatagaaccttgccattaaacatgctcaataaatgtttattaatgatgatgctgcagagctttgacagtgaagatacaagagtgactctaataaagaatccatgagttttttttaatctagcaaatttatattgctgaatgacatttacttactaaaattcaaaataataaattcaataatattcacacatgctgagtttctcatccctgactttagggtaatagaggcaacctcgctagaatcaaatagtaacagtaaaaaagagctacaatctgtatcattataaaaacaataaaagttttttaaaaaaacaagcaaaaaccgaaatatatttcctggctcacacattttagtgattctgtatcaatgaaacgtcttcttctctttaaggtataccatccatgtcacaagccacataataatttgaaaaaatcagtgactgagctatgagttaccattctatggggttgtgggttgtggggccctaagttgaggaaagtcaagaaaaagattgatggaaaaggcagaatgacctagttagtctttaaatgatgtgttattacaaacaaggaaatgtcactataacatttactagctagaaaagaaggaagtcaggggtgaaaagtaaatggtgtgtgaagcccagaaattcctccttgattatccaagtgatgctgtgaggcaaacgcttccacttaccaagaagagcagaaaaatgtccactttccttctaccagttacattatagctcttattttaagagacaaattgtgtaaaatgctacaataaatgcaattttgatgataaggacagaacattcaaatctaaaacttatgtgttagccaactttcaaaaaagtgagaaactttttgttgttgttgttgttgttggattcactcttgtcgctcagactggagtacagtggtacaatctcggctcactgcaacctctgtctcccaggttcaagtgattctcctgcctcagcctcctgagtagctgggattacaggtgcctaccataacacccggttaattttttttttttttttgtatttttactagagacaaggtttcaccgtgttagccaggctggtcttgaactcctgacctcaggtgatccaccctcctcagcctcccaaagtgctgggattatagccataagccactgtgcccagcctaaaaaaaagtgagaaacttttaaatgtgtgtatcacatattgtgggaaacattgatgtcttattctggacaagaatagctcaaatgccacacatttttaaatgtgcatcattccacattggagtttctttgcagcactattgtgttgagggctctgtatgtatccattgtgttgtgttttataaaatgaatacctggaacggatgtgtccccgtggcaggtggggcagcacctgggtggtgaagaaagtggggtgagtcaaaattgagacaagcatgaggtcttttaagaacttgaaaagtatttcaatatctgaaatagaaggctcactgttagaaaattgataatggaactagggttgcagacaaaaaagtgtttgaatctaggtgtagaattctcatccccagagggaataagctagaaagttagttcatgatcaataaaccaacatctagacaatatgaagatagagtttaaaataaataatgtacatttactgtggaaagggaatttttaattttctattgttaagtacagcaacctgggaaaagaaaaagaagttcttgatggtaattaggaaagaaaaagaaaaaggtttatccatggattaaaggagagggtaccatatgccagaaacatataatattttatctcacttaaccgtctcagtaatctcaggaagtgcatttgtaaggagaactcagagatattaagtaacttgcctaagatcacgaggttcctttgtatgtctgttcgttcacatgtaggcatgagatcagctttagtattatactaccaaagagtttttcaaggcagttgtgctggtttatataagggcttcaacacttgatgttatcacctttctggatgtggggcttcaagtgaggttatggaggtatctcagtgtggttttgctgtacgttttcttgatgactagtgaatattaaacacttatgcttattggccatgtatattgtcttcaaatcttttgcttgttttatttttagctcagttatctgtcttttgaaaaaatgatttttaaatatattttgaaaagagttctttgtcagatatatgcattgcagtgtatttaccacctatgactactttttcagtctcttaatggtcacttttgtggttaaaagctcttaattttaataaagacaattttaacaacaacaaattcagacctgggcttaacacccaaattctatgaatctaataggttaattctaacaccaaactgaatagtaaatagtgaaaaggaagtaaattaatcaaaatgtccacttagcaatttggtcgccagttaaattggcctttgagtaaataaggttcttcttcattatcggaatggtaccatacagtagaattgtcttcctagaaattatggctctgatttacttgctgaaagatcattgattttcataggttggtcttgtacccattgatctcaaagctttctaattagctgtaattatgagtttttgctgattttgtacatgagattgtggtgtccacaaatgataacagttatatcttacttcctgtaccttgttgttcctgtttattttttcttatgttctttatattgtgtatatttaaggtatacaaggtgatattttgatatatgcatacattgtgaaataatagcaatcaagctaattaatacatctgtcacctcacacaatcttggtcaggacctccagtactatgttaaacagtagtgtttccagtgaaagttactcaatattctagcatagttgggacacataatggtgtgatttactaacatagggaagaaagagaaaggaatagtttggaggaaaatgtaatcatccctgtgataggaccaagtaaagacagtagggagctggccatgaatgtctctagctctggaaaggggtaattctaggagatttaaacttgggaatcatcaactgacaagcattaacttaaactgtgaggttactttccagtttctgctcaggaagagctggagggttacacccaactttaaaacaggagaaaaaaagccagaagtgtgagctcctcacttttttttaaatccactaaagagaagatattgcaggacaaccaagtaatccaaatctaagaagagataaaagactacaggctgaaatagggtttgaacacacttgcttagttgattcagatcaagtcagacgtcaataggcaggactcagctggaataacaggtgaattggtagaggtcaagtgtgggttggtgagggacagtggagtccctgggggctgcttctatgcggagaaggcagggttcatattctcttgaagactttttctttgtgaatccaggcattcacagggaagcctgggaagagtgcagagaaaactttctcaaagatgctgcctgagggaggggagaaccagcctctgcagtggagatgctggactcagcctggactctactgccccgtgtccatgaaggaataaaaagtcttaatctgccgtgggaaagagaacaaaagctgtcaccctcaggccgagatgaatactcattgcaactggtgtatgaaaatgggaaaactcatctatcccagagaatcagcagtaatatattctaggctcagaaccacagcagtcagaggagaaggggcactcctcaaagccacactcccaagaccaaagaacatagtccctggctgaagccgaggacaaagaagaacaaagaacaaagaagaatatcctaaacccaaggtactgataaatctgaggccagtggtacactcaacataaataaacaataacgaatcccaaacccagcccaagacctaactagattaaaacaaacttccacaagaaaggccaaggagaaggaaaaaaaaagccaatttccaagcacaaaactgtttacctcactctctactattctacaggagatgttcagctatcaacaaataaggatgaggaatatggaaaggcaagagacaaagcaatcaaaagaaccacttagacacagacctgtctaacagataatttaaaataactatgactatgttaaaggcatgaatggaaaaggtgaacagcatgtaagaccaaatgggctattgcagcaactcaagacaggaatcaatggaaatgctaaaaataaaaatgaatataaatgtggataaaatacacttttgacatgctcaccagtagattaaaaaccattaataaatataaagatggattaatagaatttttacaaaatgaaccagatataactaaagcaaaaataaaaggaacagagcatccatgagttatggtacaatgtaaaatggcttaacataggcattattgaaaccccaaaagtatgatagagatttgaggagaagaaatgtttgaagaaatattggctaagagttaattagaattaattggtccaaaattaattagaaaaaccacaccatggatctgagaagttcaagaatactctataaataaatgccaatataagtgcatttgtgtacacagacacacacacataccatgttcaattgctgaagaacaaaatatgagaaggtcccaaaggcacccacagggaaaagaaagacacaagaggggaacaaagataagaattatagcagactttttgtcagaaatcatgcaagacgaagacaatgaagtgaaatgaaattattattattatttttttgagatggagtctcactctgcctcccaggctggagtgcaatggcacgatctggcctcactgtaacctctgcctcccaggttcaagtgattctcctgcctcagcctcccaagtagctggtattacaggcatgtgccaccacgcctgactaatttttgtatttttagtagagacaaggtttcaccatgttggccaggctggtctctaactcctgagctgaagtgatccacctgcctcggcctcccaaagtgctggggttacaggcatgagctaccacacctggcccccctgaagtgatctttttgaaaggctggaaagaaaagagtcaacacagaattttatacagagggaaaatatctttcaaaaatgaaggagaaataaagactttgttagacaaaaagtgagaaaatgtattgccaatagacctacatagcaagaaattttaagagaaaaaacatattaaaagaattccttgaggcagaaggaatatggtaccagaaagaaacttatatctacacaatgaaacaaagaatatttaaaaagaaacaaaggaaaataaaattagttttttatacctaattgctccaaaagataactgattttttcaagcaaaaattttagctctatagtgtatttatagcatggttaaaaggtatctatggtgtagggatcttataacagtacgttcccagttcctccttcacagcatacattgttgtgatccttacacttcacaggaagtatatataaatacagtctcactctgttgcccgggctggagtctagtggcacgatcttggctcactgcaacctccacttcctggactgaaacaattctcctgcctcagcctcctgagtagctgggattacaggcacgcaccatcacgctgggctaatttttgtgtttttagtacagatggtgtttcaccatgttggccaggctggtcttgaactcctggcctcaggtcatctgcctgccttggccttccaaagtgctgggattacaggtgtgaggcaccacgccccgctgggagaataatgttatttaaagttagatgttgattaattaataatgcatattgtaaaccttagggcaaccaccaataaaatgtgtaaacatgggcataagtaataggttgataaaagagataaaatgaaacaatgaaaacaataagcaaaaatcagaaaaagaagaaaaaagaaacaaagacaaatggaacaacttgaaaagagctaggacgatggtagattttaatccaaagagatcaactgtaatattaagtgtgaatggtttatacatacaaattaaaaggcaaagatggtcagattggattaaaaaagaaaaaactataagctctttttgagaaatccaacttaaatataaagatttagataggttaaaagaaaaacaataaaatcattaacacaaagaagctggagtagttatattaatatcatatacaagacttttgcctctgatataaaagacttttgcctctgataatttttcttgtttcttttatattaatatcatagaaaagacttttatatattattatataataatatataaaagaaaagacttttatatattatataataatatataaaagaaaagacttatatattatataataatatataaaagaaaagacatatattatataataatatataaaagtctttgatattaatataaaagtaacaagtaaaattatcagaagcaaacaggggtattgcataatgataaacgaggaatttctccagggaggtgtaacaatactatgtatgcgtgcacctaatgacagaacacacaaaaccaaaaatttaaaaaacccacaggaagtcaaaaatttttttaaaaaagacaaatcctcagttgtggttacagactgaaactcttttctttcgtgtgtgtgtgtgtgtgtgtgtgtgtgtctgtgtgtgtatgtgtattttatatatatatatatatatttttttttaaagcaggcataatattggtaagaatttggaaagactactgttaactcaatttacctaatgacatttgtaaattattatgcaagaacatctggattattcaccaagacagactatattctgggccataaaataaacctcaccaaatctgaaagaacagaaagcacatgaaatatgatctcaaattgctagggatttaaattagaaattaatatccaataggtatctagaaaattcctaaatacttggaaattaaacatgtttctaaataacctgcatgtcaaaaagtttcaaggaatttaaaaataatttgaactacatcaaagtataaataaactatatcagaatttgtgtaatgaacaaagccatgcttagaagaaaatttatacaactaaattcttatgctggaaaagaagaaagatcttaaatcaatcatctaagcttccctcttaagaaacaagaggaaaagcaagttttacccaaggcaagcagaaggaaagaaataataaagatggcaacaaagacaaaaaaaaaaaagaaaataaaaaaatcaatagagaaaatcaattaaaccgaaagctggtaatttttaaagatcaataaaattgataaacctgtaactgaactaaccaagagaaaataaaagacataaatttaaaatataaaagagaaattaaatgaacaattctatgcccataagcttataaaaggcataactaccaaatataactcaagaaataggcaagcagaatatgtttgtaccaattatgttgactgaaattaaggctgtttaggcagaaacaatttagtaaaggcttactggaagccaaatatgaggattgactggggaagacacatcagcaaagtgggtatgttccaaagtctgctacaagtccgaaggcttttataagaaagtttgggagaaggaaaggtgactcctcatatcagagttgtccttttcaccggaaggtacaatacagaggttaagatcattggcaagagattgcaacatacaggctaaaatgtctgtgtgcaagacaatcagtaaaacttcatgattctagaacaaatcagcagtgtctttgtgtcagttgtttacatgttaatcgatatgtcaatcatgtgaggaactgacaataaaatttgcggattccttattcaaggacaaaaggttaaccatgaatcataagaccatcgccacgtgggtaatttggaagcttgccaaatgtgacctaaggttatcaattaaatacattgaaggaatagttaatattcttccaaaaaggaaacttcaggaacagagggttttacttggaattctgtcggtatttaaggaataaataggggccaggtatgatggctcatgcctataatcctgactctttgggaggctgaggtgggaggatcacttgaggccaagagttcaaaaccagcctgggcaacagagcaagacgtcgtttctatgaaaaatttttaagttaactggacgtggtgatatgcacccgcaatcctagctacttaggatcccttgagcccaggaggatctcttgagcccaggagttcaaggctgcagtgagctatgattgcaccactgcactccagcagtgttctgggtaacagagcaagaccctgtcttggaaaaaaaaaaagtaataaaatgttattcaacatattctaaaaagcagagaagatagaacacttctcaactcaattaatgaggccatcactaatgtaataccagaaacaggcaaaagattaaaagagaactaaaaaccaatatccctcatgaacaaacacacacatattctcaataaaatactagcaaatacaatccagcaatatataaaaagagtaacacatcacaaccaagtcaagtttgttccaagcatgcaaggcttgttcagtatttggaaatcaatcagtgtgattcacattagtagagcaaacaagaaaactatatgattattgcaatagacacaaaaattgaatttgaaaataaattataatatccactcgtgatagacaattctcagtatggtaggaataaagtggaacttatttaacttgatgaagggtttctataaacaagttacagctaacataattcttaatgatgaaaactgagtggttaatccaaaagatccactcctgtttagcatcatactagaagtcctagttacgaaaattatttattaatagtattttatttatttataaatagtattttatttacttattaccacaggttggtagagaagtcaggaaaagaaataaaggcctcaaaatttgaacataagaaaactgcctctatctgcagacaaaatgactttctacatggcaaaacccgagaaatccacaaaacatgttctagaactaattagtgagtttagcaaggtcacaagattcaaggtcaaaacacaaaaattaattgtttttctgtgttctagcagtgcatatggtaattcaaagtttaaaaattaccattcaaaatagcataaaaatgaaacactttggactaaatctaaaaaatatttacaggatctgtatgctgaaatgtataaaactgattaaagaaatttttaaaaaagctaaatcattgggggaatatactgttttctttgtttgggagatctaatattggtaagatgtcaattatccccaacgttatatgtttctttaatgtaatctgaatcaaaatctcaaagtgatttttacagatactgacaagttcattataaaatgtgcaaggccaaggaactaaaataactacccacaaaattggaaaggaaataacataatggggatactcatacttgatttcaagatgtattttataaccacagcaatcaacatggtgtggtattgccaaagggtagtgatatggtttggctgtgtccacacccaaatctcatcttgaattgtagttcccgtaatccccaagtgtggtgggagggacctcgtgggaggtaattgaatcatgggggcggtcacttccatgctgttcccgtgatagtgaatgagtcctcctgaggcgtgatggttttatatggggcttttccccctttgcttggcacgtttccttgctgccgtcacatgaagaaggacgtgtttgcttccccttccaccgtgattgtaagtttcctgaggcctccccagccatgctgaactgggagtcaattaaacctctattctttataaattacccagtcctgggtatgtctttgttagcagcatgagaacagactaacacagatagatacacagttcaattaaacagattagagtccagaaatagactcacataaatataaccaactgacttgttgcaaagatgcaaagtaattttacagaggaaaggcagtctttccaacaaatggtgctgggaagacgggacatgcatatgaaaaataaatgcccacccatagaaatactaattaaaaattatagactcacatgtaaatttaatctatgaaaatttctttaaaaaattgggaaaatatttgtgtgacattgagacttagatacaacatcaaaagcaatattcgtaaaaggaaagaatcagtaaaatggactttgttataattttaaaactgttgaaagaatacaaagacagccataggctggtaaagagtatttgcaaattacatttctgacaaaggacttgtatctagacatgtaatgagctcttaaatcctaacagtaagaaaatgaccaacccagtcaacaatgaggaaacagatctaaacagaaacttaactacagatgtgtggatgcaaaacaaacacatgcaaagattctcaatatcattagtcattatggaaatgcaaaaactccaaccacaatgaaataccactctatgagtattattagaatagctaaagaacaacaaagcaacaagctgaccacacaaagttcaagcaaggtcacagagcaactggatttctttacttgtggtaatgcaaaatgtttcatctcccatgggaaagtgagaactttctgataatgttaaacatgtatctcccacatggtccaggcatctcgtccctgggtatttactcaagagaaatgaaaaggtgtgctcacataaaaacctgtacaggaacatttatagcaggttcatttgtaagcatcaaaagctggaaactacttaggtaactttcaactggtaaattgataaataagtgtggtatatccgtacaattgagtactactcactgataaaaagaaaggaagtattgatctatgcaacaatgtgaataaatcttaaatgcattttgctacgtcaaagaagccaaaactcaagggactaataccaaataatgccacttataagacattctgtaacaggcatacttacagaggtacagatcaagttagtagctgccagaggttagaattaggtgggaggggctgattgcaaaaggataccacaaaggaatttctggggtgatgaaatcattctgtattaaaatcttggtagttaatacgtgattttatccatttgtcaaaatatacgaaattgtacaacatgagggtgagttttaatctatgtaacttaaagtgcagacacaagatatttggggaactcaaatggaatacgaattgtaacaaatgaaactaactctattatagatgagtatcacaaccacacaacatgtgggacaggaacaaaccagttactttaaaagcattactttgacttgatactataagcccaaaggcaaaaagaatagagcaaaatgttaaactctagtaaatttatttctaataaggttatatgttagcaattctgaagctactttatatgtatatatttagggttgaatacattagtaaatgcattgtagataatgagaactgagtttttcattgtgtaagagaaagaatctacatataaagagggaaggctagaataaaccctggggtgttggagggagcttggtggtatccgtgtgaactcatgttttaaaaagcatgtgggcattacaaatatatacatatatatgcagagatgggtacaaaaataaatataaatgtgtgtgtatagttgttatgcatacacatatttttgagttctgtccctggagagggcttagaaacaatgacaccccacaacaatgaatgtacctcttactcagatcttgtattttggggggaatgggttcaggtttatttaggtataatttgtatagagtaaaatatacccattttagtgtacagttttatgatactcaaccatgtctacaattccgtcagcaccatgataatcaagagaaagaatagtttcaccacctcaaaatatacccttgtgctcttttgttaccaatcccctcccctcacttccaaaactaagtgaggccagtatgggggcaattggaagcctcatacagggctggtggaaatgtgaaacggagcagctactttggaaaacagtttgtcagtttcttgtaaagttagacattcctttaccatagacccagtaattctattcctgagtatttactcaagagaactacagactgtgcacacaccaggcctgtatgcaactgtttacagcaactttattcatagtcattccaaatgaaacaactgaagtcttcacctacaggtgagcggatgaacaaattgttactttcatgcagtggaacactactcagctacaaaaagaaatgaatttctgatgcatgaagcaaaatggatgaatctcggaaaaaataggctaagtgaaaaaagccacaatcaaaaagctatgaactctattatttcatttatataatgttctggaaagaacaaaagtacagagacaaagatcagatcttacattttaaatatcattttccaatagaaggaactagggtaccttggggaagtggtggagttcagaactggggcagagaaaattcaagataagcatgaagtatcttgtggtgtcagataatcagtaagaaaaggcaaaacagaaacaaaccaaaaaattagaacactcaattatatttgttgcaagcaggatccacccttaatgctaaaattggtgagcaaaagttcaaggagaaataagagatttgcatattctaaaagatctcccccaggttatttattaattacttaaggaaagataataactttccagtggagaaacctggcagatagcaccttaaccaagggatcaaggtaaaactcgtcagtactaagatacatccacatcttatacctcctgatacaatgcacatggattctatgttattctggccaaaaccacataaataaatctggtcaggagataacatcagacaaccccaaactaagggacgttcggcaaaataactgaccaggactcttcaaaagtatctaggtcatggaagactgaggaactatcagagatcagaggagatgaagaagacgtgattactaaatgtaatgtaggccctgggggttggattccagaacagaaaaagaacattagtgaaacagctgggaaaatccaaataaattctttagttagtactgttggagcaacattaatttcttggctttgataactgctgtgattgtacaagatgtcaatggtagagaagatacatgaaggatatgtacgaattatctcctatatttgtaacatttttacaaatataattaatttgtttaccccaatgccagttggggtaatgtctaaagttatttcaaagagttaaaaaacacaggtgcttggaggagtacagagaagagtatatataagaagacaagcataaaattggttataatttaaagaaatagcaagcaaaagaaggtgtgtttatggaaacaatgaatgttcagagaagtaagctgagaatcaaaaaaagagaacagtgtcttgcaaaccaagaaagcagcattgctcatattgtgttcctgtagagtattctcatgatataactccttcaaatagagaaatgattccatggttattcaatcttcttgaaatcagcaatacataaagtacaatgcctgtaaatagtttgagaaaggcttctctactgaccttttttttaaaaacaaatcgaatggttcccagaattatttagctatgagtcctttcttttgtttttaaatagcctcttgatatcaactttatgaaagcagcataaagttggtgccaggtacacaaacacaattcacagcacatacttggcatttatttattaaacaagtatttattgtacacctattaacatccttggactttgggatctgaagaacgtacttgggcaaagctctaacacacacagtgatgggataagtattgtgattggcgagaggattggccctggggaaaataggagtaaataaccctgagcatatgggggttgaaaaatgaggagtaatttcactgtgggctgctggtaagaagaatggagagaggatctggattgggagttagtccagaaggaaatgttacagtggccagaacgtgttttttatcctgattaattctaccttctggtcctccaagttcccatttggattataacacaaacatgtgggccttcaataagaatgttttctcatgggatggatcacaacctggtgtctccttgtaactttctgtttggagaaaatcaataaatatcatttcaaactgctaaagaatgaattttttaaaaaaatggatgtgtttgtcatgataaatttccctgacatatttattataactacttcttgaaacatttgtcagggaggcattgatgaggactggaccgttttagtcacttaggtgtattctctaaattgttttagaagagagagtttttaatgcagattaatgaattatctatgcacgtcacgataatgaagcataaagatgacttctgggcccctttctcaccttgcctgtgcaggctgagctcttccaccagctctggactgacttcctattgccttcgtttcacagtttcagtcggagatgagaaatagccctgaaatttgcttcaattcttcactaatccgagatcaaaattccccaggactgcaagggaagttgttacgcagagcagttgcagcattgggcagtaatatgtgattagcaatagaagatattcttgtgagagctgcactaacttgctttttatctgactgggccccgtaaggaacagctggttgtggttcttctgtaggaacaggcacactacttacactctgttctcttctttccagatcggtccatgtgagagatgtcaggcataggagaatagttttccctgtgaaagcttttctgctcatcttaggagagagggaaggtagattggctcccccttattctgctgtcctcataggagtcaccctttatattgatgagatgcatggtgattggtgatgagaaacaatttgagggtaccgtgaaagattgatagcagggttagattaaccactcctatgaacttgcctcagaatcacagtgtatcattcctttatatagaaaaagatgacacttgatgaaaataagcaaattcagtcatcttaaagatatttgaatgttagcttaatttatgagatgttgttactgttttaaatcaagtcataaagcagtgattattaactattttaaatttataaacttctatcataatctgataaaagttttggccctttcccccagagaatacacacacacacacacacacacacacacacacgcctgacatttaatattgactattcaatctacaaggaacaatcaggatcactgtggtagacaccatggttttctcttcaacgtctgtgcactcatttatgggcatcatgctgtttgggagggtttaaccccagccccatcttttggggagaccatgattcctctcagtcgataatatcctaatcacaccaaagggatcaggtctagttaagccaatcagtccttgacaatcccaatgttatggtttaggcatagcccaaagatcttagatgacaggacttttcctctcatccttctgctctctctccttctgtatattgtggtgggcaggtgggaagcctagaataacagaatccatttagttcccatgaaggaagcgaaccgtggcactgtgaagacaaagctgtcaactagaggcaggcagaaccaagagcatcacagagaaagagagcagcggccttgaacaaaacatgaaggaatgcactggtggggtgagacttaagcagttatgtgagctcaaacccccttagcgtgtgggccctttctgtgtaggttgtgttttctattcttttcaacaaaatagttctaaatgatagtttttcagtgctggcttttcaagtacagatgtgctggagaaggagtgaggaaagaagggtaagaaaaaaagtgttaatatctctctagcatgctgtcctgcctgtataaaaatggagctgtttatgtgtaccattagtggtgtgagtgttttctcaagaatggagatagattcacctcttgccctgtgcatctctccgctctgtgttgttactagtcttactctatggttacccaggttccagtcaaggtccatagacatggaacagaggaaaaccaactggacaagagagctgagaccactgcagcctgggatttttaacgccatgtgcgatacttgtatagaccaccactctgctgcctggctctgaggtagttgctgaaatgcggaatgtggcctgcaggtgatgtgctgagagttaagggatggtttatctttactttgtgaaattaaacttcgctgaacaaggagaagcagggaaactgacgagacctttacaaagccagtgtaaagtgtagtatgcagagcatattagacatgtccacagacacaaagcaagaaatagtgtgtattagtctgttctcacgctgctatgaagaaatacccgaaactgagcaatttataaagaaaagaagtttaattgactcacagttccacatggctggggaggtcccaggaaacttacaatcatggcggaagacacctcttccctgggcagcaggagacagaatgagagcaagtaggggaaatgtcagacacttacaaacatcagatctcatgagcctcactcattatcacaagaacagcctggggggaaccacacccataattcaattacctccacctggtctcacccttgacacaattatggggattacaactcaacgtgagatttgggtggggacagagccaaagcatatcacagtgtaaatgtacattcaggtgtttctgactgataagctttttcttttctttgggcatgtcataaaatctatattagatgtaaagatatggaagttgaaaaatgtttgtcaccttttactacccaaacccttttaaaatgacaataaaaacttacatgtgctgatgatcagagagtaattcatacagttattttgaaaactgtcactattgactaaaactgagtatgtccataccctaccttccagtaatttcactgccaactgcacacataagcaccaagagaagtggatagaatattcacagcaacattgttataggagccccaagttggaaacaatgttgatgttaatcgaagtagactggacaaatgtactgtagtatttttcatacattagaatactgcatagctacatgtggcaacatggaggaatctcatagtcatatttacaaagggaaagaatccataatgtgtgtgttagcccctaatgctatacctggaacacagtagttaccctatacatgttggtttgccatttagcttggaatttaaaacaatataagataatacaattagtgctcagtaagtaaattaaatggagttttccatttcttgttgtacatctaatgtggcatttaaaattaaagttcatcaacaaacataataaatgtgcaagcagcattttgcaaagaacattgccctcatgtaatctatcctgttctgcaaaccctaattcgtcaatctgaaaacagaaatatgtatttgctgtgcttagcataaatttaattgtagaagatggagttcttgaattcggaatcacatgatagttaaaatgataaagaatattattttttaacttttagtttattcagccttgtccattaacatttagttagcattatgcctagaataatttatatcattgcaaagaattaaattgtttgaaaggtagacatttgatagtcctgaatgttttagttcttcttgttttagaagaataagttttggatgacatagtgtgatcaaatggcttaatttcaggtgaagatatgccttatgactttcattttaaatcttaaacacctgcagagttaaattgcagtgaagctcataaaaatcgccatctgtaattgatggaacattggatttttaatgatatgctgtaggagtctgaaaagatctagtggtccattattaatagacctcccaaaaaaagactggtgggttttcttcttcataaagctgaattttatgggcaacagacaggtagggaatggtataaagtggatacaaattttttcttatttgtaatatttgaataacacaatttaaagtaagctgttacaatatcagaccaaaattgaagactgaataagcatccttaattattgcaaaataacctcttttgtagcatttagctaattcccaattaaccaggttgctggggcgagaatgcagttataactacattcagtttacaggtaatgcataaatgcagctaacaaatccacagtaatcaatagtagattatagggttttcttgtcatccctgttgttactgtttttctgtttgtttgtttttgatctgttggtgatgcttggttgggaactggaatgaacttagatcctcaggagggacacttagtaacgaggaaagagctggttatcatggactgccacaaacccccgtgtctcactacttctgtttctgcacgttctgctctgctcccttttggtgtccattctagtgtaaccagcatgttattttgtctatcgctagactgtaagctccatgagggcagggctgtttgtgttgttcactgatacatcacaattgtccagaacagggtctggcacaaggggatccaatacacatttgttgactgaatcaattatacacaattttagtattttataggggtaatctcatcccctagctcttaccttttctatttgttgatctttttcaagcattttctaggtctactccatttttcatttttccgaatttactatgctatattttttaaaatttgtaaaatatttcctctttaattttatgatggtagtgccccacaaatcaattttgagttccctcattgggaaatgggtactatatatatacttttttttctgagacagtgtcttgctctgttgcccaggctgggctggagtgcagtgatgccacctaaggtcactgtacctttgaatcctggtctcaaccaattgtaatccttccacttcagcctccctagtacctgggactactggtgtgtgtgctaccaagcctagctaagttttccttttttcgtttttagagatgggctcctgctatgttgcccagcctgtctttttatttttaaaactgttttttttttttctatcttcagtcgaatagtagaacctgaatattttcttctaatggaaataaataacaaatgtataggagccaagtgtttaaatatttgttatttcaaatgtaatagtttatctactgcttatgtttgctaagaccgacatattttatctgctggatacatttgctaggacagcattgtcttttgtgcatttattttataattggccatgtactgagctgacttagaccatgactaataggttttcagatggttcttttgagagttcttgctagtcatttacatcatttttatttctcttttacaatatttatatttcaatctgcttatatattaacccttctgttggtggttttaatgacatctgacatctgactagaaatactagttaaaacattaatgtaagtaaatgagggattgcatatcaaatatgaccacgtggaagcatgcaaataacataaattcacaaaacaatacttcaggtgacaagaacactataaaaatgttcacatccctagtaattaaaataatatacattaaaatggtatactactggccgggcacagtggctcacgcctgtaatcccagcactttgggaggccgaggcgggcggatcacgaggtcaggagatcgagaccatcctggctaacacgtgaaaccccgtctctactgaaaatacaaaaaaattagccgggcgtggtggcgcgcacctgtagtcccagctactcgggaggctgaggcaggagaatggcgtgaacccgggaggcggagcttgcagtgagccgagaccgcgccactgcactccagcctgggcgacagagcgagactccgtctcagaaaaaaaaaaaaaaaaaaaaaagatatactactattttggcccatcagcttgggcaaatcattctttttatatgtatactaatattctggtcagcataagaaacaaagtctcactactggtcagggaagtaaaaaaatggcaaacattctagaaatgaatttagcactttatgtaaaaaaacataggaaggggaagatttccttttttttgtttttgtttttgttttttaatatggactctcgctctgtcgcccgggctggagtgcagtggtgcgatctcagttcactgcaagctccgcttcccgggttcacgccattctcctgcctcagcctcccaagtagctgggactacaggtgcccacgaccacgcccggctaatttttgtatttttagtagagatggggtttcaccgtgttagccaggatgatcttgatctcctaacctcgtgatccacccgcctcggcctcccaaagtgctgggattacaggcatgagccactgcgcccggccacggaagatttccattttaagaaatgtgtcttgaaaaaagtaatttggtaaatattaaaatgcttgtaaacagatatttatcataataagaaaaaaaggcagcagtataatatctaaaccctaacagtcgttctccagagatgctgttctttgtacctgcaatgtggttaagaaaagcattttatttttctttaataattatacattaacatgtaaaaatcccatcagagtcccagcacagtggcttatgcctagctctaatcccagcactttggtaggccaagcagggaggatttcttgaggccaggaattgaagaccagtctgggcaacatagcgagatccctgcctctacaaaaataaaaaataaaattgtagccatgtgtggtggtacgcccctctagtctagctacttgggaggctaaggtgggagaattgattgagtccaggaggttaaggctgtagtgagtcatgacttcagtctcggtgagaacttgtctctaaaacaataaaaataaaataagaaaaaaagaaaagctggtttactgtggtttatgtaggcattgattttaatagtgatttacaatttcttttttttttttttcctgttgtgtctatctttctggaaggatcttaactgaaagggtatttcttacgggaacctctagtggacaccttagaaggtagagcagttgaaggagaaatatattattcacacattaatggttcgggactggtcctcatcagactggctagactcaaggcaataaatcatctctaccttcatcagattttcttttataaaaggaaagagaaattctaagttcttcaagacatggagaatattttcataatattctaggttattttgtagacattaaatctgaaaacctcaatatagtcaatgactgtattaaagcttgtagactggtttgggaaaaaaagatttctttctacattttgggacacatccagccatgtgccagaaaagtccccagaagaatttgtttgaatctggaggcacagatccactggccttctgtagcatttggtaaactgtagtctgctgctgccaactgaatgacctgttcaaaattaagtcgtctgtagactttctgaacagttactcatacgtgcaaaagtttcactgaagaaagagttagataaaaagaattcgattagctcagtggctcaaaaacttatcagtttcattgcccactttatgcaatgccacaattcattggttgacattttaacataaaattatacaatcgatggcatctcacagtccacattggctggtgtgacacagttgtcattgactgtacatgtttgtacctagtcaaaggagttcatactgccataactttaagggcagtagattgtggtaactacatgtgtatgggtctcaactcatattaaaaatgtgttcctggcagagtgcagtggctcacgcctgtaatctcagtattttgggaggccaaggcggatggatcacctgaggtcaggagttcgagaccagcctgaccaatatggtgaaaccctgtctctactaaaaatacaaaacattagccaggcatggtggtagatgcctgtaattccagctagtcgggaggctgaggcaggagaattgcttgaacccaggaggcagaggttggagtgagatgagatcgtgcctctgtactccagcctgggcaacatgagcgaaagtctgtctcaaaaaaaaaaaaaaaagtattcctgtttgttacctgaaaatcttccatggacacctccagtaagaccaagaaactgccaaaattattgctggctcttggaagaaaatcgaggtgtcagtagtggagcagcctttcagaaatgctgtatcactaatgctcttgctggcttggaagatgatgttgtgtccaaaatttcaagtggtgataaggcattgtgtcctaatttaattgcagtgtgtttttgtaaatgttataacataaaatttgttgtgtctcataatcaatgttatcttagatccaatccaagaagaaacataatttgtaatgtcccctttattatccttaaataaaattgatggataataaagctacctacatatataattttcaagaatcaatgtaattgtctatctacaatatgacagatacataaaaatatatcagtatttattcattatgaaaatgactttgcacaaccatacctgaatacctaatgaggtagtcagatgtttttatctacctatggcaaataacactggatttatgagaaataagacaatcagaagctattcttaagcaagaagcacttgcatataaaatgtacaggcacagctggatgctagactacaaagtaatggtataatgaataataagtgagaagcttttgtattgatgagagaaagaagaaaatcaccttaattaacagagatatcacaccttagaaaattataaagttttgaagtagaaataatgaggaagtgttttcatactggaactgggacttttaccactgtattgtcaacataattgcctttgttatgacatggaatgaggtagtggcaactatcattaaggatgtttacttttaaaaggacgggtgtacattcatttctctataacttagggaagatcttagagacaatatataatcttcttcaaaggtcagctggatctatggtaaaatacaggagtatctagagaatttgggttgacctctagggatattatctgagtcggatggaaaaaattagttaactacaaaatgaataaataatttaagtaactaatttttatgaactaaaaataagttaactacaaaatgaataatttcagtaactaacttttataaatttcagtaactattttttataaaataaatgaggtaataaaaactatgactgaaaatatgtttgctcttaaaagtccgggtgtgctttcagttctctacaactttaaaagatcttggagacaatatataatcttcaaaggtcaactgaagctatgttaaaatataggagcatctagagaatttgtgttgacctctagggatattatccaagtaggatgggaaaaataactactaaatgaacaaataatttcagtaactaatttttataaaataaatttctgtcattgtgctatataattattaaaaagtataaactggcaattatatgacatgtttttaaaagcatctttattattgaattcaataagatccccgagtttcctgtggctccattagtttaattgtatttggctttaagtctcctaagagaagacttcataaggtttgctgaaaacttcagtaaacattaggttagcaaatattgaatgcctaaagcttgctctttctgttgtaaaatgtttccgttgatactgacattagtccttcctcataatcgtgatttgatgatatacatgaaacagccggagaggtattcagaagaatgtaaagtatgtgaacaaaagaatattgaaaacatgatctgtcgtgtccatttttgtaaaagacagaagagtgacttatttctcctcatagtgttataaagctcagctgtaatcacttaattagaggaaggctttttgaaggaagatggagaaggaaatggcggaagagtattttggaatctcaaagagctttcctaacaaaggtgtctggtgaacaaatccttgagttcatttctacggagcaactagtcattttggaagacccgaggagataaagaaaggcctcaagaaattgaaaaagagaaatcatgtggtttgacttttcatgatatagtggaatgcagttctgttcattattatagacaatcttttattcatctttgtgccaagttaatttgttataaaaggctcagaaatattttgggaaattatatgtgttttgttgccgtgtatttttgttggggtttcattgatactcttaacgtagtatactaattagaagttagaaaagactgactacgtctatatcatgttattagtgttccacctgagagcgttccatgcaatgtcactgacactttgttttatggcaaagggacttaatcttatcgatagatttttgcagtgcagtgcacaaatccatacctattcacatctccaggaagctctgagtttgaaaactgattttcttttctttcccttcctgccttccttccttccttcctttcttttttttttttttcagatggagtctcattgtttcccaggctggagtgcaatggcaggatcttggctcactgcaacctctgcctcccaggtggttcaagctattctcctgcctcagcctcccgtatagctaggattacaggtgcccaccaccacatccagctaattttgtattttagtagagacccggtttcaccatgttggtcagactggtctcgaactcctgacctcaggtgatcaacccgccttggcatcccaaggtgctgggattacaggcatgagccactgcgtccagctaaaaactcattttcaatgctatatataataatttggttcttataagagcagacagaagcctacttagtcctataatataactgaaattaagacagaggtcatgaagaagctgtgaatacaaatgagagggagacaaggctatttctgtgtagacattatttgtaccaagtgattttaaggtggggaccatgtgtatctccagtctgaatggcagactgaggatctgtttaccaggaaaattctgggtttgcccatgtgctctccacaaacagtgctgttcaaggagtctttccccagagagaaatctattatcttgtcttttgtgataaggatttccctaatatttttattgtacacacagacacatgcacatactactcttatttataaactttaaattgctagaatcatactttattctttcattatttgcttctttcacactacagtaactttgtgagatgttcctatgttgatgttcactgttgttccacatcctcttcatttccatttccatatgaattttagaatcacctcatcaatttctacaaaaatatcttctaggacttagatgggaattaggttgaatctactgatcaatttggagagaatcaacatcttaacaataataagtattctgacccaataacattatttagttgtttagtttcagcaatagtttgactggaagactttgtgtagaattggtaatatttatttcttaagtgcttagggaaattcaccattgaagccatttgggcctgtagttttctttgtgaaaaggcttttttagcaacaaattcaatttctctaatagatgtaaggctactcaaatatacatttcttattgagtgaattttgtcagtgtttgtctttcaacaaatttgtccactttgttgaaattgttgaattttgtcacagacttgttcttaaagttgttctttttttttttcagagcaggattggaagtttattttaaaaggctttagaacaggacaaaaagaaaagcactgatattgtctggctgtgtccccacccaaatctcaacttgaattgtatctcccagaagtcccatgtgttgtgggagggacccagggggaggtaactgaatcatgggggccagtctttcccatgctattctcatgataatgaataagtctcacaagatctgatgggtttatcaggggtttctgcttttgcttcttcctcattttctcttgccaccgccatgtaagaagtgactttcacctcccaccatgattctgaggcctcccgccagccatgtgaaacaataagtccagttaaacttctttttcttcctagtcttgggtgtgtctttatcagcagcatgaaaacaaactaatgcggtaaattgataccagtacattggggcattgctgaaaagatacctgaaaatgtggaagtgacattggaactgggtaagaggcagaggttggaacagtttggagggctcagaagaagacaggaaaatgtgggaaagtttgcagcttcctagagacttgctgaatggctttgaccaaaagcctgatagcaatatggacaataaggttctagctgaggtggtctcagatggtgatgaggaacttgttgggaactggagcaaaggtgactcttgttgtgttttagcaaagagactggtggcattttgcccctgccctagggatttgtgaaactttgaacttgagagagatgatttagggtatctggcagaagaaatttctaagcagcaaaacattcaagaggtaacttgggtgctgttaaagacattcagttttataagggaagcagagcataaaagttcagaaaatttgcagcccgacaatgtgatagaaaagaaacacctattttctgcaagctggctgcagaaatgtgcataagtaatgaggaaccaaatgttaatccccaggacaatggggaaaatgtctccaggccacatcagaggtcttcatggtagcccctctcatcacaggtccagaggcctagaagaaaatggtttcctgggccacttcctcccatcacaggcccagagacctagaagaaaagggtccctgtactgtgtgcagcctagggacttggtgccctgtgtcccagttactccagccatggctgaaaggggccaatgtagaactcgggccgtagcctcagaaggtgtaagccccaagccttggcagcttccacttggtgttgagccggcaggtgcacaatagtcaagaacttgggtttgggaacctccacctagatttcagaacatgtatggaaatgcctggatgcccagacagaagtttgctgcaggagcagggcactcatgtagaacctctgctagggcagtgcagacggaaatgtgggatcggagcccccacacagagtccctactagggcacctcccagtggagctgtgagaagagggccactgtcctccagaccctagaatggtagatccaccaacagcttgcaccgttcacctggaaaagctgcagacactcagtgccagcctgtgaaagcagctgggatggaggctgtaccctgcaaagcgacaggagtggagctgcccaagaccatgggaacccacctcttgcatcagcgtgacctggatgtgagacagggagtcaaaggagatcattttggagccctaaaatttgactgccctgctggatttcagacttgcatgggccttgtaaccactttctttcagccaatttctcccatttggaacagctatatttacccaatactgatacctccattgtatctaggaagttaactagcttacttttgattttataggcttacaggcggtagggacttgtcttgtctcagatgagactttggactgtggacttttgggttaatactgaaatgaattaagactttgggggactgttgggaaggcatgattggttttgatatgtgaggacatgagatttgaaagggccagggatggaatgatatggttcggctctgtccccacccaaatctcaacttgaattgtatctctcagaatttccatatgttgtaggagggacccaggaggaggtaattaaatcatggggactggtgtttcccatgctattctcataatagtgaataagtcttgtgagatctgatgggtttatcaggggtttccacgtttgctttttcctcattttctctcgccgccatcatgtaagaagtgcctttcacctcctgccatgattctgaggcctccccagctatgtggaactataagtccaattaaacctccttttcttcctagtcttgggtatgtctttatcagcagcgtgaaaatggactaatacaagtacatttggaagagactcaagcaggcacatgaaggtcaggtgcccttaaaattttcttaatattctcttattacccttttaatatttatagaatctggccggtgcagtggcttacgcctgtaatcctagcactttggcaggccgaggtgggtggatcacgaggtcaggagatcgagaccatcctggccaacatggtgcaaccccgtctctactaaaatacgaaaaattagccaggtgtggtggcacatgactttagtcccatctactcaggaggctgaggcaggggaactgcttgaatccaggaggtggaggttgcagtgagctaggattgcgccactgcactgcagcctggcaacagagtgagactatctcaaaataaagaaagaaagaatagaatctatagtgatgccacctcttttatttttaatatttgtaagctgtgtcttacctattttctctgcttagtttggttagaactttattaattttatggatcttctcaaagaactagcttttggttttatttattttctccattattttcctaatttctagtttattaatttccaccctgaacttttatttcctttcttctacttcctttgatgttaatttgcttttctttttctaagtttcttaagatggaaaccaagatgttgatttgaaacctgtgctctattctaacgtagacatttaataaatttccttctaaaaattgctttaaaagactccctcaaaattaatgtggtatgattttattctcattcccttgaaaattctttataatttttaaatttcttctttgattgcattttttgtttcttctttgaaatatagattatttaaaggggtataatttggtttccaaatatttggatatattccagcgatcttgctgttataaatgtttaatttattttcattacagtcatatcacatacatcccatgactttaacccttttaaatttattgagacttgtttcatggcccagaattgggtctactgtggcgagtgatccatgcacacctgagaaggatgtgtgctctcctgctgttggctggagttctctgtgataaaaagtcggtcaggtttgttgatcctattgttctagtgttctacatccctgtttacttattctatccattattgagagagaggtatgacagtctatagctataatgatagatttttccatttctctttgcagatctatcggtttttgtttcatgtagtttgaagctctgctattaagtgcataaacatttagggttattatattctcttgagggattgacacctatatcattgtgaaatgatccctgtatccctggtaatagtatatgctctgaaatctactttatctgatattaacgtgctcctctggctcttttatgacccatattaatgtgatgtttggtgaatgatttgatttgcccaaattgaagcctggtgtttgtctccagctcctggaagtgaacctttaaacccttgaaatgtcttgagtgataggagtgtttttgttatttacggtgggtccctgggactatgcctagtattttatgctacaaatataatttgtgctaaaaatataacacgtggcacaaaggccacatgttaccaacctgatctctgggggtgggtggcctagagactgagttcaatgggccagcaatgaaacaatcaatcatacctacataatgcagccacagtaaaatctctggtcagcttcctaagttggcagtactccgtgtatatcatcacatgtggattccaggagggtaaaatacccaggagccctgtgtgtttcctcaacttgagtgtggactgggtttagtgacttgcttctagcagagagaacgtggcagagttgaagagatgccaccttcaaaactgggttacaagaagactatggcttgttttgcctctttctttttctcactcattctaagggaagccggctgccatgttgcaagctgccctgtggaggggcccacatgacaaggaacaatgtgtatgacaccaactgccaagggcctgggatctgccgtcagtcacatgagggaacttgaaagtggatcattcccatttagctctgagatgactgcatctctggctgacactttcatcacaggctttcaagagactctgagccacaggataaaactaaaccacacctcgattcttggcccacaaaaactatgggatgtgttaagctactgaatttgggggtaatttgttatacaataagaactatctaacaaccagatgtaaaaaatgaaggaagaagaggagaagaagaaaacggggaaagtaaagaggggaggaggaaaggagaaaaggatggagagtgtggagaaggaggaggaataggatattatattaattaagccttaagctcaatgatgcaaaagttctgactcagactggactaaaacaagaaagttcataatatactgtaggaggaagtcaaaaacaggaagaataataagctcatatgattcaatgactcagttgtgtctttctatttcaatattggcttcatcctcagccttctagcaagctgactcagcctgaatttccagtgtgttagcttgggttgctgtaaccaactaccacagactggtggcttcaacagcagtcatttttttcccacagttctggaagctggaaaacccaagatcaaggtgccagcagatatgcttcttggtgaattctttcttcctggcttataggcggccacctcatgtgtatcctcataaggtagagagagggagctctggtgtccctccatcttcttcttcttttttttcttccttttgaaatggagtctcgctctgtcgcccaagctggagtgcggtggcgagatcttggctcactataagctccgccttctgggttcacgccattctcctgcctcaggctcccaagtagctgtaactacaggtgcccgtcaccatgcccagctaatttttttgtatttttggtagagacggggtttcaccatgttagccaggatggtcttgatctcctgacctcctgatccgcccgcctcggcctcccaaagtgctgggattacaggcgtgagccaccgtgcccagccccctccatcttcttagaagggcgctaatcccatcatgggagcctcaccttcatgacctcgtctatacctaattacttcccaaaggccccacttcccaatgcattgaaggttagggattcaatatacaaattttaggcaggtttcggggatgcagaaattcagcccatagcatccaacagctagacaaagaagagatattggttctttggttttccctagaagaaagaaatgtcttctaccatcccccagctgattttatttcttgtcccactgcccagtcctcaggcacatgccagcggcaatcacaggcaaaggctctgagattcattcaacctacttggggctggagatggggccccttccactgaggcccttggctacgaggggatgtggaggacccctaagtaaaattgtgttccttaaggcagcagtccccaacatttttggcaccagggactggtttcattgaagataattgttccatggaccagactggtatggagtggcaggtgatgggtttgggatgattcaagtgcattacacttactgtgcactttatctctattattattacattgtaatataaaatgaaagaattatacaactcaccataatgtagaatcagtgggagccctgagcttgttttcctgcaattagacagtcccactggggggtgatggaagacaacagatcttcaggtattagattctcataaggatcaggtattagattctcataaggagtgcacagactagatcccttacacgggtagttcacaacagagttccagctcctatgagaatctaatgccactgctgatctgacaggaggcagagctccagcagtaatgtgagcaatggggagtggctataaatacagatgaagctttgcttacttggccacccctcacctcctctaggaggtgtgcggccctagacaaggccgtggactggtactgggggtcaaggacccctgctttagggcatgaaacagactgatagctactggtagctgccaacggtatgaatgaagatgttcaattcttctacagaaaaattcttcaccttcacagttgatggaatgtagtagaaatttctgtttgactcttccatggtatctttcagactcactgatttatctaaatatatatattttttatggaactagtcagccatacccatcttcaatcttataagcaaagaaataacttctaaggaatttgtacgatgaagacatatttttgagctgagtggctcctaatcgcccatttttccttgagggagcatttattgagtgtttgttgtgtgctggcagtggattccagactgaacaaagcagacactgcccctgctcccggagagcttgcaccgcctccatgtacacaccatcccgctctactgcagctgtcctgatcacctaagaagtgatcatcagattctacattttatagcccataacatttcctcattaattcattgaagtttaaacttctcatccatgtgtgtgtagcaagcttagttctgcaaaaatgtttgaaatttgccacttcctctaaaaaagatattttcttctgtgatcattaattataataaaatgtgtttacactcttgagactgaattaactgtctcattctattatcccaatatttatgcatttgtaatttagataagaattattaatacaattttaccatgagctgtatgaaacagatcaaaagtgacagtaacaaggcatattataagaaccctaaagtattcctttttagacaaaaaatagcatatctggcagagatgcacagaaaggggaatgctagtacacttctggtgggaaggtaaattagtacagcacagccactgtggacaacagtatggagggttctcaaaaactaaaaatagatctgtcatatgatcctgtaatcccactgctgggaatatatccaaaacaaaagaaattggtatgtcaaagagatatctgcacacccattttattacagcactattctcaatagtcaagatatggcatcaacctaagtgtccatcaacaaatgaatggatagagaaataccatatatatacacacaatggaatactagttagccataaaatagaataaaatcctgtcatttccagaaacacacatggaactataggttgtcatgttagttgaaataaaccgggcacaaaaagacaaatattgtatggtctcactcatatttaagagctaaaaaagttcatttcatgaaggcaaagagtagaatattggttacagacgctgggaatggtgttgaggggacatgaagagaggttgcttaatgggtgcaaaaatacaatgagatgagggactacattctaatgttcaacagcacagtgactacagttaacgaaacttttttttaatggaatctaactctgttgtccaggctggaatgtagcggcaccatctcggctcactgcaacctccacctcccaggttcaagccactctcctgcctcagcctcccaactagctgagactacaggcatgcaccaccgtgccaggctaatttttgtatttttagtagagacggggtttcgccatgttggccaggctggtcttgaactcctgacctcaagtgatctaccctccttggcctcccaaagtgctgggattacaggcatgagccacagcacccagcccagttaacaaaactttattatatatttcaaaatagctggaagaaatgatttgaagtatccccaacacaaagaaatggtgtatgtttgaggtgatggatatgctaattaccctgatttgatcattacatgttgcatgcaagtatcaaaacatcacatgtacttcaagaatatatacaattacatatcaattttttaaattattttctattgcttagtttaagctgtttgtagagcttatgtataaactgcagcaaatgcagaaagtcaatcagtggccaatggcacagaacaggcagcacatttcggaatttcaaagccctgtgtgcgcttatctaatcaccttaatatttgggtgcatcacacaattttttagacaatgttctagtttctaattataaaaatcatgtgtgtttcagttttcacagtttcaacaccaaagaaatgtatctatcactcatgagaaggaatcaaggaagtcaattttggaaagtcaaaaatgaccatccatcctcacaacgcagggcataaattctatgtcaggtctccttgcacatgctccacgttcctcattaccctatgggttctttcaaacctcatcagtcctcgacctgtgccttaaagacagcaggtgtacagcggtagagggagagcgggaatggactctgggtcactggtcaagctgcccagctgtgcactgcacaagagggaaatcctcagagtagattgtgtggatgatggcaggaaagggggccactccagccgctctgctgggacactgttgagagccacacagacccctaagctattaagtggcaacagaggagcctcagagcctatttgtggtgggagaagaaagaaaaaagaaattgcaagatggctcaaggcaattgctaaacttttttggaggacgtggaaaaccgtggaacttctccccaagaaagtacataaacaaaaagtcctgcattaaaattcagagagcccttgaggcagctcttgttctcagactggccatggttcattaaaagttaactggactcttcttctccaatactgatttctctgtttctaaatttctcacatatctagcacatcactttgtttacagaaaataattctgctaggaagtcagggcaaatattgatctcctcatgtctcaaacagaggggaaaattcacagaagcaaactttggaaagtcaaaatgaaaagtgtaagtgacttgcctgagatcagatggttatgtggtggcaatgccgagatgttgaattgcattgagctggaactcagaaagtttcggtcaggagcaggcacaccatggtgccaaattagcttggctttcggagtggggcacacctaaatctaaatgccatttgtgcacgttgcctaagccaccagaaactttgtttccttacctctgacaagggaataacaatctgccacacagggggccccaggagggttaaatgaggtgaaaagaaataatagctcaatcccaaaaccagcgctcacctgtgcctactggtggggaattctccctataacgagtcaccttgagctttatttaaggggccttccttgttgaaatactgaaatgttactaagactttcacacagtaatatttccaaataagaattctgtctgtattccagaaatttgagagatgataaaaaagaagaaacaaacaaaatattggctgatttctgaaatgagctcatctcctggcctgaagtatgacatctgattacccctcttccagcacaagttattacactcctttactcaattattgatgttgtaaaatgcactcgaattttatctctgtgatgctgctgcctccaattcccttgcctattcgggaaatgcataaggaaataaaattataattcttacttctgaagaaaaacctgttttgaagtttgaaacttgtgtcactcattgaaaaagaagccccctattttttattctaaagaacttggaaagaagcatgtttaatgtgtcagggactcccagtggctctactttgaggacacaccgaggatctgaccacttttcatcactgtggtggtcttgtccagctgaaacaccctcgccccaatcactgcacagccttggaactggtctgcttccttcctcgaccctctgatatgctcagcccggcaggcaggcagggtggtcctagaaaaacatgcttcagattcactgctgctgtgttccacgtctgtgagagcatggtctctcatgcagagtagacctggcccaacaacagctcacaaggccctggtaaccagcgtgcccgcatctctccccttctccacactggcttggtccagacacgtgggcgtcccaatgttcttctacgatgccagcataccctagcctgggatatttatccacttgtccctggcatatgcaaacagtgacggttaacttaatgtgtcaacctgagtgggatacaggatgcccagattcaacattattttggggtgtgtgtgtgaaggcatttctagatgggattagcatttgaattcgtggactcagtaaagcagagagccttccccaatccattggggcatctttcagtccatggaggcggactcaaatagaacaaaaggcagaggaaagaattcacccctttctgcccctgcctacctgcctgaacggggatgcttcacctcatcttctctagcccttggactcggattcacgccactgtctccttggttctcaagtcttgggactcatacggaattatatcactggctttcctgcctcttcagtctgcagatggcagattctgggacttctcagcctcctaatcatgtgattattcctcataataaatctccatatatatatgtgtatatatatatgtattatatatgtaaagatatagatatctcttagatatacaatatgtaaaatctccttttatataaattatatataaacttacatatatggagatatacacaaacagataaggatatatatgtatatatagaaacagataaatgtgtatgtgtacatacacacacacacatatatatatacacacaaggatatatgtacctctcctattggttttgtttctttgaaggaccctaatacacaaactctttatccagatatctgtactccttactccccaagaatttcaagtctttgctcaaatgttaacttttcaaggaggtcctccctgtccaccctctatctgaaattgcactataatccctagtacttttttttttttttgagactgagtcttactctgttgctcaggctggagtgcagtggtgtgatctcgactcgctgcaacctccgcctccctatttcaagcaattctcctgcctcagcctcgtgagtagctggaattacaggtgtgcaccaccacacccagctaatttgtttgtatttttagtagagatgaggtttcaccatgttggccagactggtctcgaactcctgacctcgggtgatccacctgccttggcctcccaaagtgctgagattacaggcatgagccacagtgccccacccactagtacttttgatatctagcttgctctactcatggtaccgtcattcatcaattttagtgtagagataattttctatattttaatatctctagaattaggatggatctttacaaaccctatcgtcagggaaaggtgatgatattgttgccattgcttgtagatatacatcaaaacctgtagcatggatgtcagaggcttatgagaaaaatattaggatggtgcaaaagtaattgaggtttttgccatttaaaaacttacagctggacccattggctcatgcctgtaatcccagcactttgggagactgaggtgggtgaatcacaaggtcaggagttcgagaccagcctggccaacatggtgaaatcccctctttactaaaattagctgggcgtagtggtgggcacctgtaatcccagctactcgggaggctgaggcaggagaattgcttgaaccctggaggcagaggttgcagtgagccgagattgcaccattgcactccagcctgggcaacagagagagacttcatctcagaaaaaaaaaaattacctttgcaccaacctattaattaagcactgttaatgacatcaatcctgacattgtactgggaaaaaaatgatcttgactctattggtgttgaaatgtgattcagaaaagccaaccctggatgtgaagacatttcaggaatgcagaaacaagtttatttcatttgtattttcctttcagcttattaacaaaattgatatgtggcaaaaatcatcagtagacacaaagggttattttaatgaaataaggacttaagtaaaaattaatatttcaaattttaagtgccaaaatgttgtttctttttcattggtataggaagcaatggtctttattacagtcaatgacattttagacttgataaaatatagtatatgactgatgtattttgttgtttataacctgttgactttgttattgttagtccaagggccccgcagagagtaagcctcaggaaataatagcagttgttgttgttggaacactcttagaatgcatccaagtcagacgtcccaaggaaggtaatcttgggttaagttttgaaagagtggcaacgtttgtttaaaatactttcctcccaagtctttactattgtgagtagtgctgcaataaacatacatgtgcatgtgtctttatagcagcatgatttatattcctttgggtatatacccagtaatgggatggctgggtcaaatggtatttctagcccaaatgtccaacaatgatagactggattacaaaaatgtggcacacatgcaccatggaatactatgcagccataaaaatcataagttcatgtcctttgtagggacatggataaagctggaaaccatcattctcagcaaactaccgcaaggacaaaaaaccaaacactgcatgttctcactcatatgtgggaattgaacaatgagaacacttggacacaggaaggggaacatcacacactggggcctgtcgtggggtgggggactggcggagggatagcattaggagatatacctaatgtaaatgacgagttactgggtgcagcacaccaacatggcacatgtatgcatatgtaacaaacctgcatgttgtgcacatgtaccctagaacttaaagtataataaaaaaaaatacatatatatataaatactttcctccctcgtttcatctggctgagggaagatcacatatctgacgtcaggaagaatgaagtgtttggcagctcaggaccatttttcatgatcagaacattaaggtgcctttggggacagggagaaatgagccctccctgcctctggtcactcctgtccattcagccagagtcctgccctgacacctggctcactgaccaccttatctccccttttaaatcttacagagtctctgttcccagctcctccaccatgggaccctcatggaagtcccctatccagatgtaatttctctgccttctctgaattctaagcactttatactcctgtaattaatgtataaatcatacattaattcattggtttacttctttgacaaatatctgtagggtgccttctctgggtcagtccctgttcaaggcaccaggaacacaggtgaaggaggtacagtgggtgtgagactcaatttccagcttcagtctaagctcctgcaattcagggatgagatttcatatatacatttttcaatccttatataatgccttccatataattggtggcttataaaggatgatggcttatggtctttattacttacatgtctcatcattcctgtacaactgtagcaaatataaacatcaaaatgcctctagatcttcttttcctcataacatattttctcctttctgtcattttgaaagtgttgtatattgatgcccctggtcatttaggaatgcccatttctctttgttctagtgctgttgtgtgggtgaaggttgacctagtttcagagaaggggtgaggaaaggcaggggcaaaaagaataaaggaaagagtttcttttgagtacaaataaaaactaccagggaaatctgatttaccaaaatgttctagggattagatttgcaactattaaatatgatttaactgaaggacccctccggccttttttattcccttcttttttactaaaattctttatcgaattgcagaatcctttttcatttgtctcagtaagtaaacttcaataaattataggtaaaatttagaaaactgaaaattctgttagagattagaatgcattaatatttcttgccttaggctgggtgcagtggctcacacctgtaaccccagcactttgggaggctgaggcgggcacatcacctgaggtcaggagttcaagaccagcctggccaacatggtgaaaccccgtctctactaaaaatacaaaaattagccaggcatggtggcaggcccagctacttggtaggctgaggcaggagaatcgcttgaaccagggaggtggaggttgcagtgagccgagatcgtgccacagccgagatctgtgagcctgggccacagagcgagactccatctcaaacaaacaaacaaacaaacaaaaaaaaaaacaaagaccatagaagcatatgaataatatgaatagggttttggagatttcacaggacatgcagtaaatgcaaggcatcgtagaaaaataaagtgtccagggtgagtcccccaaatcagcttgcttccttggagatgtgccactctttcctgaaagtttacaacaaaggaaatgtcagttatctgaggttttggcggggctcgggtggaatgttgtgatgaattattccttaaatgccctgagactgagcatgggttccaatctggatgtttccagctcagctgcaggaggagggagaatttagacagagacgttgtccgccaaagctaaataccttccgcctttgcctacttttcatttccaaacaccagtattgattccttccacgacgaatcgatcttgtggcttgaaagaagcctctacctggaagctgtgggggagggatgaagtgcaagagaaaacatctgttaatctggacagaggcagcgtggcctgaaatgaagacataccaagcccatcctgggaagaagtgtttctccaggtggcagcctgcaggaagcagagctccttctgaacaggcttcccactggctcctttctttttgatatttttttccagctttgttaacgtatgacaaataaaaattgtgtatatttagggtgagcgatatggtgttttgataaacacattgtgaaatgatcaccacgatcaagctaagggacatacccatcctaaccttgttgccactgtgtgtgtgtgtgcctgagtgtgtgtgcctgagtgtgcgtgcctgagtgtgcgtgtgtgcacgtgcgtgcgtgtgtgcctgtgtgtgcgcacgtgtgtgcctgtgtgtgtgtctgcgcacatgtgtgcctgtgtgtgtctgtgtgcatatgtgtttgcacgtgtgtgtgtgggcatgcctgtatgtgtgcctgtgtgtgcgtgtgtgcctgtgtgtgtgcctgtatgtgtgtctgtgtgtgtgactgtgtgtgtgcgtgtgtgtgtgtatgtgtgatgagaacatttaagatctgctctcagcaaattccaagtacacaatacagtgttatatacattagatctgcagagcttattcagcttctatctgaaaggttgtaacctttgaccaagatcacccgtcctcaactactgttctactctatttctatgagtccacctttttagatttcacaagtaagtaagatcatgcagtgtttatctttctgtgcctgggttatttcacttggtataatgttcgtattcttgtaaatagcaggatttcattctttttttaaagctgaataacatttcatttgatagttactacaatttcttcatctatcaatggattcttaagttgcatctgtatcttgattattgtgaataatagtgcagtgagcatgggagtgcagttatctctttgagataatgatttcattttattttttaacgtacacccagaagtggaattgctagatcatatggcagttctattttgatttttatttttttgtggaacctccatactactttccataatgactataacaatttgcagtcccaccaacagcatgcagtttttcccttttcttcacgtccccaccaacactcattatattttgatcttttaataataaacatcctaacgggtgaagtgatgtcacattgcagttttgatttgcgtttccctgatgattagtggtgctgagcaccttaatatacacctgttgcatctccgtatgtcttctttggaagaaatgtctattcaggccctttgcctattgttttacttgggttatttgattctttactattgagttgtaggagttccttcttctctttggatattaattctctgcttttcagtgccttaaagtttctgtgtccccacccctaccacgtgttagcctttgctcagttctacatcatgtctgctcatccctgtgacccagcgctgtgcctagcatggacagatgctcaaagcgggattgatgactgaatggatagacaaatgtggcttgatgttttcccgcaagcagttcgtagtcttgtgaatgctcagtggtaacacttccgtaattcctccccattctactcttcatctatgcttcctacctagaatgtttgagttggaggagcttgcagccctttccttggtgcagtgttggtggaactcaggaaattgtagttcctaaagataatgtgatcacctaaatataatgacttgctggtagagagcatggagcagcaccagaaagcctgtgttctaaccttggatctgtttcctgctgagggtatgtatgagctccacgaagttgcccaacatctctgagcctcactttctcacatctcccagttgggtgattattcctctgcactctcttctcagggttgttacaagggtcacatgagttaattgatgtgagaactttcaaataaagtgtagaaattattcatgtgttagggatcattatttttcagcctattctctcccaaggagtatctttgtatcttagcagaagtctccagtgccttaaagaagctaccattagaaggaatccaggcagagtcctgaagaacacgttttggatcctgatgagtcttcaggtcactgttttgacaacatcatgctgcagttttaggcaaagttcaccgacttgatgccataaaagcgagtttgcatgacataagctggacaagtaccatgcttctcatctcacagctgtgaagccttgtccacgtgttttttgtatttcagagaacaactgaaatatcaccatcatttcacagcagctcatttctggtgttgacacatgactcatagggttttagagttggaaaagaactgataggtggtaagacttacgatgtatgattaaccaacccctcagtgaaccatgaagtttttaataaaacatataaaatactagacaggaataaaccttcatcctttacagtattactgatacacagtgagaaaactcaaatacctggagcgaaaggaatgggatgacattggtgtaagaggcactgggaggaaatagtcaaatatgtatgttactacattaaataggaattagaggagggaagaatcatttgcctaactagtgtttcttccaaaatcaatggaaatttaaattgaatgatatttttctcagtttttcttttcttctacttgttttctctcctaaataatccaaatcgctccctctcctctctctctcctctctctctctctctctctctctctctctctctctctctctcagtaagcaccaggatacctattctatggcacatgcttgatagttcttgctaagatactcaagtcttaagtcctaatcaactttcatttttatttcatcaagagtttaaacattaatttagtgataatgatagaatggtaggaaattggtcccatagcctcagaacaaatcacaccatataaatgtgtctatcatattcaagattactttcttttgatgaactgttctattagtgcatagtttaaacacatggccagcctatgctttaaccagtactggaatttaacacacagcggcaaacaggaatcttgcttaacttgacttggactgttgctcagcgcctgctgctgaccctctggtgagaatgcaataacccagaatgacggatgagtcagggaggctggacagcagattgtccagaacagtatgtaattcccatgagagggaaggctgtggagaccagctcacccacctcactgactccctgcaaggcccgagttaaaggatgctccacaattccctctccattccagaatgacatttcattctgatcaatgtcctcttactaggttgacttttactctctcaaatgcgctgtttaaaatacaagttgctctggaatatggcccattaaatgaattactggggcagagcatttttccctgcattagagaaccaaggcagcccaatgagaattggtgcctaggaggatgcagagtgaggaggaatgagcagagaggggagggcaggacacatcaacatccaaaatttgagtcgtccacttcatgatctcctttttggggtttgcttgtcacttcttcagggaccctctgccagtcgaaggcattgtgtccaccctctctggaaggctgcctgtgaggaatgacaggagatgagaccacagaggcacaggacactagaagtcagagaaacttttgagaccatgagtctcaattcctcattttacagacccagatattacagctctgctcttaaagtcacaaaacttatgtaaacgttgtgtgttttgctgagctagatgaagaccattttgaggccttatgcacctgctgtgtttttggtgggactctctcctgtccccaggctaagattctttacatgaattctcaaattccacagatgatgagattttatagcatcttccagtgttgggtttggtttttgttattttgaatgagcgtgctgactgtaggaaatgatgaactcaagtggcagttgagatcagagggactgaaaacaaagtcaagtgtaacaggatgctgctttggtggtgtttttaccgcccaaatgcacagcccggatccacacaccttgacttcatctctgttccccatttattttccaccggatctccgtgggcacttttttctcctctttcatcttttcctctactcagaaaagtgcttataaaagagcaacggtgatattgcttctatttgtcttcttgaaggaaactggtttaccctgaccctctctcgtgcatttccagccaggtcgattcttcttaggcctgtgtttgtctacgctcaccttttaacatttgggccaggggagggacaggatccttaaaacatgatacctatttccacatctgaggaaatgtaaataggttgttgtagattttcttaatatcatttttgtaccaattcctcacccaggcaattcactacaaccttgaaactcagcatgtttctgggtattctgtctggtatctgaagactctccgaacccagttctgcatgtggctaaattacaaactcagaggagcagcttccaaatacgagaattttctgggtggtgatttagtcaacatgtaaatgctaagctctgattggaataggaaaagccccctcaaaaatttatttttcagaatgaatgagtcaaagctctacgacttcctgtctgctggacacaaaaccagaaagcctgattcaacagagaaagtggctgaggtcaaggctgcaaggactaatttaggattgggattcttgctcttgactcaggcattgaagtagcctcacagagaaataatacattccagaaatgccttggtttctgtgatctccatctagaccaacaaatcgccctatgtaatcagcctacagtgcatctcaagaaagtacaatataaatggaaatatacaacctactgagaccaaaacaaagatttattttaaaaaaagagacgtctttacatgcatcactagattttaacggtaatgaagatgggtcattgagggtataaaacgctggaatcctgcatcagagtgcctggtgaggaaatttttttttattattattatactttaagttttagggtacatgtgcacaatgtgcaggctagttacatatgtatacatgtgccatgctggtgtgctgcacccattaactcgtcatttagcattaggtatatctcctaaagctatccctcccccttcccccatccccccaccctgcaacagtccccagagtgtgatgttccccttcctgtgtccatgcgttctcattgttcagttcccacctatgagtgagaatatgcagtgtttggttttctgttcttgcgatagtttactgagaatgatgatttccaatttcatccatgtccctacaaaggacatgaactcatcatttttatggctgcatagtattccatggtatatatgtgccacattttcttaatccagtctatcattgttggacacttgggttggttccaagtctttgctattgtgaatagtgccgcaataaacatacgtgtgcatgtgtctttatagcagcatgatttatagtcgtctgggtatatacccagtaatgggatggctgggtcaaatggtatttctagttctagatccctgaggaatcgccacactgacttccacaagggttgaactagtttacagtcccaccaacagtgtaaaagtgttcctatttcttcacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgagttcattgtagattctggatattagccctttgtcagatgagtaggttgagaaaattttctcccattctgtaggttgcctgttcactctgatggtagtttcttttgctgtgcagaagctgtttagtttaattagatcccatttgtcaattttggcttttgttgccattgcttttggtgttttagacatgaagtccttgcccatgcctatgtcctgaatggtaatgcctagggtttcttctagggtttttatggttttaggtctaatgtttaagtctttaatccaaggaccaacaaaattgatagaccactagcaagactaataaagaagaaaagagagaagaatcaaatagatgcaataaaaaatgataaaggggatatcaccacccatcccacagaaatacaaactaccatcagagaatactacaaacacctctatgcaaataaactacaaaatctagaagaaatggataaattcctcaacacatacaccctcccaagactctaaaccaggaagaagttgactctctgaatacaccaataacaggctctgaaattgtggcaataatcaatagcttaccaaccaaaaagagtccaggaccagatggattcacagctgaattctaccagaggtacaaggaggaactggtaccattccttctgaaactattccaatcaatagaaaaagagggaatcctccctaattcattttatgaggccagcatcatcctgataccaaagccgggcagagacacaaccaaaaaggagaattttagaccaatatccttgatgaacattgatgcaaaaatcctcaataaaatactggcaaaacgaatccagcagcacatcaaaaagcttatccaccatgatcaagtcggcttcatccctgggatgcaaggctggttcaatatacgcaaatcaataaatgtaatccagcatataaacagaaccaaagacagaaaccacatgattatctcaatagatgcagaaaaggcctttgacaaaattcaacaatgcttcatgctaaaaactctcaataaattaggtattgatgggacgtatctcaaaataataagagctatctatgacaaacccacagccagtatcatactgaatggacaaaaactggaagcattccctttgaaaactggcacaagacagggatggcctctctcaccactcctattcaacatagtgttggaagttctggccagggcaattaggcaggagaaggaaataaagggtattcaattaggaaaagaggaagtcaaattgttcctgtttgcaaatgacatgatcgtatatctagaaaaccccattgtttcagcccaaaatctccttaaactgataagcaacttcagcaaagtctcaggatacaaaatcaatgtacaaaaatcacaagcattcttatacaccagtaacagacaaacatataaacgctggaatcctgcatcagagtgcctggtgaggaaattttttttttattagtatactttaagttttagggtacatgtgcacaatgtgcaggttagttacatatgtatacatgtgccatgttggtgtgctgcacccattaactcgtcatttagcattaggtatatctcctaaagctatccctcccccgtccccccaccccacagcagtccccagagtgtggcgttccccttcctgtgtccatgtgttctcattgttagcctctctgacatgaaaatcctgaagcatcccagtggtacttcaacagaagaggtgacacaaactcccaagaagttagtcctttgtcagaaaaagataaccttgtacagcttccctaaaacaaattcagacagagatctggtcatcaacactcctgtttaaacttgcaaagccatcatctctgtattgtgagttatctgtgtttcattataaccgaagttcatctgcacaaattggcattctaaattgttacttgttattctgcacattttatgatgagatagttacagaaataaattaatataaattaagagaatatcacaaattagtagaataaggaatggccaatgtttgtcaagaagctagctaaggtttccaatgtcatttattatataaattaatattctcaccacatatcataccccaatctcagatgtatttaagtagctaaatagaaaaatagaaaaaagaaaatattgtgtgttatagaaactaagaaaaatagaaaaaagataatactgtataatagaagctaagaaaatggagataaataattattatctcaacaaaaatatcatcattagaataaaagcaataaaagccaaaaaataattagaaggaaaatatttatagttttactgtataataaacatacacttaaatataaagcagaaataaaaggaaaacaagatctggtaaaatatttgcaacaaatttcctatgttaatatatatatttagtatgttaggagatcaaacaaattaaaaaatcaggcaaaatacatagtgaagatgtcctaaaaaccaaaagcaagtttgaaatcagtattaattgttgctctcctatttgtaacagtgaaaaattggaagtaactgtttcccttatgattaaatattgacaacagcatgcaaattgataatttacataatatttaagaggaaggacaaagcagatataattaaatcccctctcttcctttaaaatgattgaaataagagtaaagaaacccaaaaggaactatgtttatatgacactgaaaagcaaaggaggaagccacagaccaagattttgacaaatttctgcaagacagaaggaagacaggatcacattaataaacatatcccagtagaggaatccatggctcagagcacaggtgagacccatttactaggaatgcactcactcccctaacacccctctgcatggagcagctacacagagaaatgagatttgacactaagagggtgatttgtggaacggatgcaaggcaactcttaccaagcctctctccccgtctcccaactgtagagctgagaacatagcctcaatctcagaaggtggcatcaagaccagcgggagagaaagaactagtcaacaagcgatgctaaataattcaggatgcatggcttacccatatggggaaacataaaattcttgccaaattccaggggttcagtctagcttccactgctcaccagggcgtggaaaaccaatccctgagatgagtattgccagggaggaaggtttcatttggatgacgccagccagagagattggagcaaaacctcaaatctgtttcttcttcctgcctccaactaaatttaggggtgtatatagcagggaaggaaaatggggctgggagggcaagaaagaagagttggtcaccaggcagcaggtgcatttcattgtacaaatcataagtttatcaagcttcagttctgtgggcatgtggcttgttagaaaatcaggctactttcaaaagtagtcatttttctcagtatacacatataaaatccacatgaattaaagatgtaaatgtggaaaacaaacctaaagctttttgcaaatatataaacaaatacctttataacctcattgggaagggaaggatttcacacacatgacacaaacatcacaaactgcacacagaaaagataaaagtcactgtattgcatttaaaaacgctagttcatccacatatgccatggaatactatgcagccatcaaaaggatgagttcatttcctttgtaggaacatggatgaagctggaaaccattattctgagcaaaatatcgcaaggacaaaaccaaacaccacatgttctcactcataggtgggaattgaacaatgagaacacttggacacagggtggggaacatcacacaccagggcctgtcgtggggtggggggaggggggagggatagcattaggagatatacctaatgctaaatgacaagttaatgggtgcagcacaccaacatggcacatgtatacatatgtaataaacctgcacattgtgcacacgaaccctagaacttaaagtataataataattaaaaaaaacactagtgcatcaaaagaaatcttttcaagtggaggtgggggagggtgagttacatatggggagaagatattctcagcccatagaacaaaagtttgtccatccagaatacctaaaatatactacaaatcagtgaggaaaagatgaacaaacaagtagaaaaataggcaaatgatgtaatccagcaattcaaagagagaaagtccaaatggccaatgcatatatatatatatattctcaaactttattcgtaaccaagaaagtgcatattaaaactgaagagagacatcgttttatgcccatcacggtggcaaaagtggcagcatgtgacactgtgatgggctggagacagcggcggtggcagctgtcacacatagctggattaagccctggaaatttgatgagggggcaatgccagcactagatatagaattcatttacatattaaaacatatataaaagaatgtttgctgcagcattgtttgtaaaagtaaacatttaggtaccatttataaatgcattagtggaaggatggataataaattgtaggatgatattatagactactacccagtggcagggaaaagctacagctatcagtgaattaacaacacaaaattaggttgcaagatatattgtatggtgccatttatgaattgtaaaaatgtaaaacaatgacacatttatctagccagatgtaggttaagatagccaaagccagtttttaaataagtgggcataataaacactgagtttaggctggtggtgagctctgggcagggagggaagaaaaagcaagtagattgaagtgggcaagatttgtgactttttctttttcccgagacagtgtcttgctctgtcgcccaggctggagtccagtggtgtgatcccagctcactgcaacctctgcctcccgggtgcaagcgattctcctgcctcagcctcccaagtagctgggattacaggtgcatgccaccacgcttggctaatttttgtatttttagtagagatggggtttcaccacgttggcaaggctggtctcgaactcctgacctcgtgatccgccctcatcagcctcccaaattgctgggattacaggcatgagccaccgcgcctggccttttttttttttttccccttttcttttcttttttttttttttttaacttttaagctcagaggtgcatgtgcaggtttgttatataggtaaagggtaaactcatgtcatgagggtttgttgtacagattattttattacccaggtatgaagcctagtacccattagctgttttccccattgtctccttcccattctccgccctctggcaggcttcagtgtgtgttgttcccctctatgtgtcctgtgttctcatcctttagctcccacttataagtgaggatatgcatttcttaaaagaatgttacactactgttgggatatttttctaagtctgcttttttttaatcatccagaaggtgtcaaccaaaaacttcctggtaataaccagtactcctattcctgcctgagtggctttcctgtgactggactgaaacgtcctgcagctgtggttgaacgagggtgacagccaagtttgcatggcacacacatcatgactgctgcctgacccacagacaccacacagtacaggcttgtttcagagatgccaaatgtggggaaaatgcatcttaaaagtcacagaagtaaatgtagtttattaataaatgtaataatgaataaatgattaattatttcatttataaggaggacggatgaaagaaagagaatataaatgcatttattaccactgaactgtatatgtaaaaatggtaaagatggtaaattatatatgcatattttatctctatttaaaaaatcactgaaataaatgtagtttgatcagtatttgtttcaggaatatttctgcagcttttttgtttgtttttgcttataatttttggcctctttttcttctttatattttgcttttattctcctgttgttggtataaaaagataattcatccaatcttaaagctaggaacatttttcttcaaatggcaaaagtttagtaatataaaattacatcttctttgtggctataatcacgttacttagttcttcagggaatgatattttcatatgcctaatattttaaatgtttttaattgattttcagtttcccaaggaaggagaatctcctttccaaagaggttcctttgtgattttggaacagaaagtcaatagtacaagcctcaacattacaagaggcatggtaggttttctgttggaaggtactggagacagatgtaggatacactgcatttttcattttacaaatgggtagcaagagatgctgtgtaaaattgatgggtacattacttaaggttcttccagctgctatagcaaataaaccctgtaatctcaatcttttaagaaaatagtagtttctttctcaattgctcaaaataaaatttattttattacaataaaatacatcagttatttagcagaggccttcagaatgctgaatcaagaacccaggtccctccaccttgaacatccatcatctctgaagattcaagaatagtttaattccaactttagaatgggagagaaccagagagttctcagaaggcatccccggatgttttgaaggccaggcctgaacctagcacatacttctgccatattccagtagctagaacgtagtcacatagcaaaggaggccaagaaatgtggaatagctgaagagcagccgaaaaaagaaaatcagtttggtggataatgagcaagtttcttccaaaatggattaaaaaacagtgttttaaattcattagtaaagtgataatgtcaatttgaaaagatgatacaggaaaaattggtaagaaaaggagaaaagaacaattgattgtggaagttagtggaactctttgtcttacagctgagaggtgatggattgtgtttgaactggggaaataaggaagtggatctgtgttcctgcttcctgggcatacagagctgtccaccacagaactagcattgacaccggcaaaattgcttttctctgagaacttggagagagaataggggtcatgttggatttggtgatgatagtgatggtggtgatgaggaataatttatatttttattgtaaattttcagtaatattttgaatttttattttaatatacatggataactttaataattacataattaatcacagtaaaagtggtaaaatacaagctgaaaattaaatccaaggacagagatccacttaataagcaactatagacatggaataagaatattttttcataacttttattattacattagcaaatattcatatttttaagaggaagtgcagagtagaaaactacaagtataatctcttttacataaatactatgcatagaaaagactagaagggaaccacaggtgttgttttagtatatttatttatgatgaattatagtctttatttttgcttatattttatctttgttgtcagctatataatgagttgtattaatgtctatacttttgtgtctaaaaaattgaaattgaatatttcattgtcaaaaactaagccatgacagaaagcacaataacttaatagtgaagtagagttcagggtgcttggaaccgtagctggctttgtctaatggtgagataatcattaggattagaactcaagagccctaggtttccatcccagatatgttgctaactaaatgtgtgaccctatgtaggtcactttatcagcacctcggtttttcacttgccgagtgatgttcgcattttcatttcctacaacctgagtattttaatgcagccacgaccctggtgctgcctgttgaaatgaggcagattaaagaccacaaggcctatggcaggaaagatgcttctttttccacctccagtgacaagctctgtgagatgaagtaaatcttctaattcagtcaaattctgctgctggtggcttttctccattggtcatatttatacagctggggacctacagcgcaagcctctccaggggagcccttcaggtcttctgtagctaaatattcccaactctccctctccatgtggctcacgggtttgccatttcctcatcaggttggcttatgcccaagttagcacccttatatattctatatcatttgatccccaaactccattttttccactcagttatttctgtaggtgagctgctcgcagtgaaaaataggaaagggggggaatcttttttttttttttttttttttttttgagatggagtctcgcactgtcccccaggctggagtgcagtggtgccatctcagctcactgcaagctccacctcccaacttcacgcaattctcctgcttcagcctcccgagtagctgggactacaggcgcacgccaccacgcccagctaattttttgtatttttagtagagacggggtttcactatgttaaccagactagtctcgaactcctgacctcaagtgatctgcccacctcggcctcccacagtgctgggattacaggcatgagccactgtgcccggttaatcattttgttttaaataagtttcagttagaatatagagcttcttccccaaacagagtaaccttcaattctccattttcatgtaaaagcaggtggcatttcttgtacactgtggagatggtatgattattaaacagctaataattagaaagcattccagaaataaaatcagcatataaatacctagtatgatggggatgattaaactaccggctgtggtggacaaaaaataatattattcaattgtttacatgcatttagctgatctaacaaaacatacatttgtaagatcccagccagaaatatttccaggtaataaaatataaattatagtgttcctttatggattgcatactttcttccttctttacgtttcaaataaattaccttctatgtatcacttaaataacatcaggctttctgaggtgcttaagacaatcttaacagtactgagttaaaatatatctttaacatgctattttttctagtctttaggaaagcttcactcaagtgcattttcaaaggtctttgaagatgaaatattctgagggcctcgtgcattgctgctgaatttaatagtccttagcaatcacactgaaatccattccctttgccctcagcttcccttcctaattctatcacgtaactaccttcttcctcaaaagccttcttaccaccttagcaaaaaatgacaacttggatttcagtgaaaatgtatggatttaatttgcaagctctccagtcttggctttgctctctgtgagtcttgacggaggggagaagctacaccggaagccctaagaagcctggcccaggctcacctgatctccttctcttccagaagcctcccaggttccagcccactctcaccttccacagggggcctcttgcctcccggcttctgcccagttcagccaatggaagtcaggggtgcgagctctaagcggggggatgaagagttggggttgcaggtgggtctggccgctgccctctgcctcaggttcccacagacagccctgtcctgaagctacgagatggctgaaagacaacacaattccccagtccccggcagccgcgcatttaatttccactcacagttttgccttttccagaatatcaggaaagggaatcatgacggatatactccccggggatcagggaagaggactcagggtgtgaggggttgtctgggagagctgggaagattccatgtcttgattgtcgtagccgttacatgactatttacagtcgttgaatctgcatgctgaaaagggtgaattttattgcatgtaaattatgtttgcaaaaagccaactaaagagtgagaaataattatgtctgttttcactgcagtcaattcccccacgacaatagggggattttcggaagatgctttgatatcataactctgttgtgcattgtgcattttcataagtcattaatatttataggccagctaacttcatccctcttgattttgattattcaaggagatgctaaacaaaatgtgtttcaggagaaactcacgtgtccacagctttccgtaccattggccaatctctgggtggtcctcccttttcaattttctaccctatcacatcagaaataggtattggggttgggcgcggtggcttacgcccataatcccggcactttgggaggcctaggcgggtggatcacttgaggacaggagttcgagaccagcctggccaacatggtgaaaccctgtctctactaaatacgcaaaaattagccagtgaggtgatgtgagctgtaatcctagctactggggaggctgaggcaaaagaatcacttgaacccgggaggtggaggttgctgtgagccaagatcacaccactgcactccagcctgggcaacagagggagagtctgtctcaaaaaaaaaaaaaaaaaaagccaggcgtagtggctcatgcctgtaatcccagcactttgggaggccgaggtgggtggatcacctgaggtcaggagttcgacactagcatggccaacgtgaggaaaccccacctctactaaaaatataaaaattaaccaggcatggtgggcgcctgtagtctcagccactcgggaggctaaggtaggaaaatagcttgaacctgggaggcagatgttgcagtgagctgagatcacaccattgcactctagtctgggtaacaagagtaaaactccatctcaaaaaaacataaaaataaaaaaaaaaagatgtaagtattggaatgtatgtcctccttggtggctgggaagctttcaagaccagattcatattcatgaaggttttctcttaagtcagctgagtatttctttggcaatacgattcctcaaacatttaacagatttctgatttatttgttttccctgaattctaaggactagtatctacacccaaagtttggcttcaccttctccagtgtgcctgagttcatcacccctttgccttctctcagtccacagcaactggcccgagacaacttagaacagtaagaggggaggcagcactctcatcagagctgtggcctcagtcacgctactcagctgagtagcttcgttaggctttgctgtgggaagcgttgtgacaccccatctgtttctgtttgggttcaagaagctgacaggttttctaaacctcaaggtcctaaatttcttgatactcctatcttcctttcattttctttgcatatatctctttcctgtgctcgtctgtgtcttctattaatttacactgttttgtaatgaaaaatggtcctgttctctcatcttggagagaccccctttaaggaggaccacttatgaatcacctccaaaggctctaccgtagatagacgtactgcttgctccttccattcctattcccaatcccctttgaagtctcctctgacttccccagagattctcaggctgctatggaggcacagctgatgaaattattcatatagaattggtacacagacatattatatttgatgacagtcggttatcttccctccattgtaccagacagtgccccttagggacatgcacatggcatcttgcccatttttttcttttgttttgttttcttttctttatttttgagacatctcactctgttgctcaagctgaagtgcagaggcatgatttcagctcactgcaacctctgcctcctgggttcaagtgattcttcggcctcagcctcctgagtagcagggattacaagtgcacaccacaacgcccggcaaattttttgtatttttagtagaaacgaggttttgccatgttgtccaggctggtcttaaactcctgagctcaggcagtctgcccgcctcaacctcccaaagtgctgggattacaggcaggagccaccactcctggccttttgctcatttttctaccttctgtgtctaacttactgtcaggttcataggaggcacccagtaaatattggccaaataaaattgtcttcatttacaaaagaaaaataaaccttgataatatgtgtaaattgttaagcatgcttgcctggtaccataaaataatacaaaatagccctgcacagtcttttatggagatgtcttcatataaaggcagcatagagaagacagcacattgactgcatggtgacccatcggaaagtgcttttaataccactgggaaactgaactgccagggccatctccaaggaagaacaaagcttcagagagtgtgtgggattggagtagatggggaaatggatgtagggtatttcaagctaaaggaaaaacagataaaagtcagctttgggaatgggcctcataggttggggaataacaagacaacctgcccaaccaaagtgaacacacatttgggatagaatttaggttgcctgaactgctttggatttttctagatatagaaaactaggctatcttttttgtccttctgtgtaatctcccaaccctagttgtcattgtatccattgaagaatggtctctctgtgtccttgggatgcttatatttgctccttttggtctgcgacatttttaaagagttgcaatttcctgttgtttgcatacatattctgaaaaactgtatttatgttaatgattagatacaaaaggtttctgctaatatcccccacctgctaggaaattaatttgggttctacatttgtctagaaagggtctaagtattatcaccctgattaaaaattcacctaaaaacttctgtgtctctgtgttgcatatagaaacatcaatatggcttccatatgcacttgttattggaggaaaaaatagattaagaatcccaatacattaatgatagccatgaaatttagctctctgctgatctttgcttaaaaattatattcagcaaatatatatatatatgcacacacacatatatatgcatacatatactaacacaaaaataattttggcatatagatgggtgtaaaagtgaaaatgtaactcatttattcaaatgtgtaagctaaacgtatttggaaaaataaatagaacagtgaaaatcattaaaattaacctttatgacattttctgggaaatttatgactaccaagtgttgaagaccatgtttgaaaagaaaaaaaaattagaaggcataaataaaaaagttaagtcattaaatgataaaatattctaaagaaatttaagataaggtgacagaatacaagcatggtaactttcttaacttttagaagaaaatgtaacactgaagtttaagttatgccaagctataattttaacaattttcagaagaatatataacagtgtataaaaatatccatgtagcagaaagaaacacagacaacaaaatgaatttaaagtttatgtcatatgttgtacttgtgcttctgggtagacggagtagacatccttttctccattcctcccactaagtgcagctaaagccactgggcattacacgtaaaacaaatgtaagatgactctgaaagaaggagggaagaaggcagaccacctggggagcttgcgactggaggaagaaaccaggggtgaattccttgggttttctttttgccttatatctccagactaggtagttgagaggctgacacaaaaccctagtgtgtgcaaacaaacatgccccaagaaatgctcatctcttgccaaagaccaaggaatgggcaatctaagacagcggccactctagtccaacaaggaccacataggacaccagagtccacttctggtgccacaaggagaagtcgactggagagctttgccaggctgcaatgtggccccaaactcccaccaggatggcatcagaggaggccaagtgagagacttcccacttctacccacacagtcaggggctgcgctccccgtggtgtcaatgcagaccctgtagacagctggacttttacctgcaccctgtgtaacaaggtgccccctaccctccactgggggttgtccaaggagcctagtagagtcgggatggtcactgatgctcggagataacgaggcccctgccctagagtgtcagtggggactccacaaggagcggtgatgagcttctttgcttctggccatggtgttttgttgtgggtagtggagggtctgaatcccacatcaccccacagcagcaagaagcccttcctccagtgccttccaagaccaagtgcagaacctgaagtgtccctccccactggcagtgtcatgagaggcccacttcctctgcagtgcagtgtccgagagggcctgcaaaacaggacgcttaagtaatatcttgggtacccaggggtagggcagtggagggagacagtgtgactgtggcatagcaggagagagggcttgtggtggggacgcagttccatgtcttgactgtgttggctgttaatggaatctacacgtgggattaatgacccaaaatgatacacgcacacatgtagcattggcagaagctgagggaagggtgggcacctgggacccctttgtactatgactgcaattctctgtgaatctatcattgttttaccaagaaattctttttgaaaagtatatgccatgtgtcagagatggcataatatgattgttattatatcaataaatgtgattaggataaaacttttaattaggaaagaaagtatatctgattaaagagtatattcctgcgcaaaatatggaaataggtatgcaaacatgtttgtatgtgcgtggggaattttgggatggatacacaaactctggatagtggggctgataattgagaagaagctaggaatttgcattttatttctgcctttctatactacttgcaaattttactatgggaactaatcactttcataattgaaatgagctacctgaaggctgtaaagaaagaaatgatcttgaaaacataatattttaaaaatctgcttataaataatactaaaaccaaattgaattaaaccacagaagtctggatggggaaataatttgaatgcaaggtacatagaatatttgaatatatttgttccaaaattgacatttttttgggtttctttccaatcatgcccagtgtgtggtacagttacacagatacatcatggttgtgcatttgtcttgcatctgcgtagctagttaagcacaaaggcaggcccaggagccagtgtagaaacaatattttgcaatttgggaggcaagaaccttcaagcaaattattataaaacactcaaagtctttcctggggccatgttttggctttcgaggtctgtgtaattgcttgtcctcctcccttttattttgagacagagactcgttctgtcccttaggctggagtgcagtggtgcgatctcggggctcactgcaaactccacttcccgggttcaagcaattctcctgcctcagcctcctgagtagctgggattacaggtgcatgccaccatgcctggctaatttttgtatttttaatagagacagggtttcaccatgttggtcaggctggtctccaacttctgacttcatgatctgcccacgttggcctcccaaagtgctgggattacaggcatgagccaccacgcccggcctgtcctcctcttttttgtctctctccttccctgatatttggcactttaagatttctgtcctcattcattctactgtgccttcattccacaaatcaattgttgagcatttactgtgtgacgggcagccttctgggcattgagaatacagctgtgaggaaaggaatgccacttctggaacgcagcgtgcataccagctttgggtggacctctgatggccacttttcattttaccacgcctcagtctcctagacaacagtgtggtgtccaacagggagccggaactgggtggatcagattgttgtcagattgaccgattgtttcgggtactctttacctgcaaccttaggcatagacagcggccaccccttcttataactgcaaggagctcgtgcccctcatccactgtcaccaaatgctactctgtgattctatgtgccttgccatcaggcagccacgaggagggaagctgagatttcatcggagaagctaattggggcatggaattgtattttgaaacttgtgctccattttattatgtgtttataggagactgaaacagaacaaggaaaaacaaatttgggctcaacaataatgtacttgtctcctggttacagctttaatcatgtattaaactgtataaatctttttcaattatattaatttaactcactatcaatggcagtggattgatggcagaacattttcagttttcattgttagccaaaaagccctcagcgaagtaaataacttaggaagaaatatgtaactcttctctgagatgagcttggaagggtttcaaagctttggtcattggattttcattatttaccatagcaaaacctgctgaaagagcacctaatgctaaataattccttcttatactctttgtgcacatttaaaaaaatgaaacagtgattggcatggcctaacacaggtctttgattaatggtcttaagaattttgcaagctttctcaactttccaagagcaatttgacctatgaagacagcctttggtagacccacaaaggggtccacagagatgaagaataagaagtgtctgattgagcatggacaggagctctcttttctctccctgttaatttcgaattggccactgtttaatcattcttgtgctcgtgcttggtaacagtggctgtggggctggggagtgtgctgtgttacacatggtccatcatgagtagaattttatctcataccgaatttaatattcttatgacttaagaaacagaatcgcaccagggataacaatagcttaagatatatttcacacattttgtctgaagagcttaggcaagagagaaaatacgtcattctattaaatactgactgcttcacttccaatgaaataacggattgattagcatttcctaagcaagctgttctgcatttatttgattcacttagcgtccatacatataactgatttaaacttaacattcttcctacacttttacagatcacatcagggaaaaaggaagattttcatggaataaattaacttacactaaaaacaatttgagcacagaaacattagcagaatgaatatttatgaatttgcaattaattttaccgattttattgtgtattacttactatgtaatatgtgactaatttaatgtactcatttatgtaatagatgtctacagaggaccaacaaggggcccagcactgtgtaagtgccaaaattacaacaataacagtggcaaacaaactccctattttcatagcgttaatattctagaggaggagctaacatttccaaaggcagctccacgttttctatgacctataaagaagaggtgagatgatgttgcctgcatgtggctgagtgaaaggcagccagcaaagacctctcagaggaaggaaattgacacctgacctgaagcccaagtgcatgaagaaactaagctacgaagagggacagagaggaggtcagtgaggctacagcagggggtggcaaacgttttctataaagggacacatagttgacgattttggatttatggcccagacagtctgtgtcacaatgacccccttttatttggcaagtaaaaagcagccacagtaatatgtaagctattatgccaataaaatttatagatggacaccgacatttacatttcatataattttttgtgtcacaaaataatgtttttttaattttgttatacccactgaaaagcataaataccattcttaggtcacaggctgtataacgcaggcagtgggctgggtttggcccatgaggcgattgtttgcagacctcgggccaaagaccagagagggaagaagatgagggggctgaggtgggctctaggtcactgtagaccttagagaaactagcattttgttctaagagaattgcaagccatggagggaatttaagcagaggagaagcggtctgatttatgatttcataaagttccctctggttgctgtcatgagcgcctcataataggcaagtgtggaagcaggaatgctgtttaggaggctattctaagaggctacaggtgacaggtgcagggtggtgggggtttcaacccaggtgagagaagcaagtgggtatgtgagtgtatgaacataccatattatatctgttcttcctctgcagcctccagcctggctctttaaataatcaaaacttatggttgtagcaataaaaactagcctactttagatttcagcttaattatattaccaaccacatacatgtttaatctcttcttctcgatttaaacgaaagcaaggacaaatcctctgttctctgctggtaaaagggatatgtcaaaatctccagccacgagggggctcctgtcatcatgcctcatgtgttcataactacaatttatgacgcctccttctgtacactgatttcagttgaatgcttctagagaatactgttgaactgagtctgatgatacagatgtttgcattttatgaaaaaacaacattctaatgcagttcatggatatcctccacttttcacaagttgcttttgtaggctagtggtgtgttcttccccaggcagtttgcctgatgccaaggacttagatacatcatttgccatcagtggaagtctgaataggatggagggatatataaataagtcaagaatgcgtgacccagagtgacatattatactggaatgatggtataccatgagaatatgtggcataaggtagttagaggttttgatgtcctatgtttagcagtgatttttttctgtaagcacacggttgttattccaaagataatatgtactttcaagcataagtgactttatttcaatctatagtctctttgagtaatttttattcttccatttccaagactcatgtcgtgttggggcaatagagatagtgtactgtagaactgttagaatcccaaatgcctccccttgcactcatggaagctcagatgtggggtggtattagaaggatatacttgcttatttctcaatgtgacacagctaaggtgcatatcattttcctttgccgtgtatggaaaacttagcactcatcttcaacatttgtttagagatttgggctacatggtatctctggttgaggcctggcagttttcatggcaatgcgaaaatgttgattgaatgacttcctaaagtattcatctcttgcctgtgcttcagtggaactgcatgcacgctgcaaaggggattttccagagttgtggatgcaactaatctcctaaatagatctccatctctagtcctccatcacccaactccactcatgtcatacgcaatctaaaacgtaatcctctttttgtataggcataagcatgatttacaaactctcaagatttaaactgaaatggaaacaataaaaagggagaagccagccgggcatggtggcccacacctgtaatcccagcactttgggaggctgaggcgggcggatcacttgaggtcaggagttcgagaccagcctggccaacatggcaaaaccccgtctctactaaaaacacaaaaattagccagcgtggtggcgtgcctgtaattccagctactcaggagcctgaggcaggtgaactgcttgaacccaggaggtggaggttgcagtgagctgaaattggagtgtcactgcactccagcctgggcaacagagcaagactctgtctcaaaaaaaaaaaaggtgggggtgtgtggggagaagtcaaattcacctatctggctttggaatctctctacactacatagttggcatgcactcatgtcttgctgtacaacatggtcctaagtaactctatcataggactgaaaaaccttggctcacgcatttcctaccagtgggaccaaggacaatgcattctgctttcatctctgcagcctttaagacacagctaaccctccagcataaggatttccatgcctcacattgtcttaaaatatctgttgtactttttgccttgtactttaaactcccaacttcttggttaatagtgtgagtatgggccaggtgcggtggctcatgcctgtaatctcagcattttgggaggccgagatgggtggatcaccttaagtcaggaattcaagaccagtgtggacaacatggcaaaacccggtttctactaaaaacacaaaacttagccgggtgtggcagtgggcgcctgtagtcccagctactctggaggctgaggcaggagaatggcttgaacccaggaggcagaggttgcagtgagctgagattgcaccactgaactccagcctgggtgactccatctaaaaaaaaaaaaaagtaagtacatcccatctcctcctaggaaagattaaaatatatttaggaatataatggtaaattaatttctttctatgctaatactgtcagccatggtgtagatctggagcaatgtgcttaaccctctgggcctcagttttctaagtcaaaatttcctgagtctcagttcatttatatgtaaaatgaggataagaacctccactttacttgcttcttctaaaggttaaattgtacaataaaatgaagagcccagcagcatgtcacgcatcagggattagcatagttgcatatcaccttttggtttacatagaatttcacaaatattatctcatttgattcttgaaacaatgagatggccagaacatgttgttttgcatcattttatagttgagtaaactgaagtcaggagggcctattagcaagctgcatttgctggaactgcctattcaataattatttaataaataaacaatttagggcaaggagaatgtgtcttttcatatagagaaacaacgtggcaaatgttaatccagttaagtaggtacatcttaatgctaaatgattattcgggtaaatatagctggagcatttgtattttcactcggcaataactattagcaagtactctgtacaatatctcagcaactcaatacagtgcaaggctcctcttgaggaatggtagtattaagagagaagtaagcaaaattgacaaggaagaacttgtttatcttggctaaagtaacatgtaggtgccccctcattcttgttatatatgcagataacagattataaataggtgtgatgttagtgaatccagaggggaactaatggaagaaaactgaatttatttctgtctaacatattgtttcttgtcagtttccttcctttgtaatataatttttaacaaaatgcctgacaagtaatttagtgacagatgtgattaatgctgacgtggcttttaagtagcagtgaacagttagaggaagcattgttgtaaaaataaaggctgtcttcctggtgtctttcaaatacctagaaaactaaaagactaagtttgccctctactggaattcagaattataccactggcggttttatgactgtgtggaaaaaaaaaaaaggatctgtgtatttttcgtttccaggttacaaattcaagcctccttttaccaccttggttaatccgctttagtattagttctatacatacataagattctgtgaaccaaatgctctcaagatagaatttccattcccatggaagccggctgtgagggcaggtgatcaggtgctctacacaaggattacagcaggaattttggctctcctactcattttgcaaaatatgaataatcacctaacacacagtctggggttttagtagtttttgattggtgttaggaacttaaaataaccccaagaataaaattgtgccagaacctagaacatcatccaacgattggttttgaggacagacctaagagcagccaaaagggaaagggggtgttacggaggcagaaagctgcttactggccttttctaaaaactgcacttccagttcactggctctgagcatgcctggtacaacagtccagggggtggaattattacggcagctgccctgggaccagtgccagtagaggtctggagactctagggaagataaaggtcaaaaagatggatcacaagacccgtcagcaggaagtaaagctggtttaggcaaagcaaagtgcagccctaatttgtcctctccttctggctaaacatcatttagtcttcctcttccttatctgatctccaaacaccaccagccaatgcctatattttgttgtaacatgaacatttatacgtgcacactcagtggtgcacagatttcagaaactggaaaataggacgtttgccacgctggaggccaatgcaaatcaacaaatcaaacccttgtgtgcctctttctggctcagatctttttcacaatttatcgcgtttggccaaaggttcagagagaaaatagatgcaatattatctatcaaagctagagtgagcatttgtacgtggggtgggggtacagggggaagaagagtgcatcccagaccctattttactctgatatttagactttagtatctaatatagcagtttgctctgattttaaaatagccagggaaaagtgggttcaaaagttacctatgcctccataaaggacattatataatttatctttgctggtcctctggaatagtagaaactggctcctattatctagatcaaggtgttttattgtaaaaagagaataatgacatttgttttctcagtttgtagaaacatagtcagtggattaaattttatacatgtttgagctttctctcaatatttttcataaaacgtaggtagcctgccagtacttatccctaccagaatgaagcttcttacagtctctgataaggcatgatgcatgttttgatgtaaatattttaagtttattgtagcatttcatgcccatgatatattaaaccaggtcatgaattccagggctctgccccatgaacaatattagactcactctgacttccagttaaaattactccccaggttcagataaattgtgaaaataaaagatacttggattaccctctatcttgtggctcataagagagtggctgctgcggaggctggtccagcagcatccttggtcagtcagggccatcggtgtgcctacatcccaggcggagggatgcaacgtgctcattgtaatcatcatgccacaccgccaagaaaatatttgacactgagatcagaagacagggattcatagagtttctttttagatcataatcacttctaaaccatggggggttaaataggattctccttcaaggaaagtgaaaacttttgaggtgttttctttctcaaagtatacaatttgtccattacaatgggatggtgcacaattttatatctactaaaaatgtgtttttttttgtttttaatccaggatattcacagcaatagctgccaatgtttggccctcaacaatgggtcacaagtattatgataactaactaatctagcatcgctacaattctgcaaggcagatgttcttgcctcaagctttagttaaagaaatagaagcccagacagcttaaataccttaaccaaattcacttagctaatcaatatgagacactggattcagactcaggtttttccaatactcacactcatctttgtgccatgctacctttccaggaaacctgttaattaaaaatcccttttctactcagaatatatacttttcaatgctaatacagaccgattttcctactgtcttattgaatgtatagagggtcactggtaacatcaaataacaatgcccttttccagatctttgtagttttttctttgtttttatttttgttttgagacggattcactctgctgcccaggctggagtgcagtggcaagatctgcaacctccacttcccaggttcaagcaattctcccctcctgagtagctgggactacaggcacctgccaccatgcctggttaatttttttttttttttttttttttttagtagagatggggtttgcccaggctggtcttgaactcctgacctcaggtgatccacctgccttggcctcccaaagtgccgggattacaggtgtgagccaccatacctctttgtagttcttataaaagtccactacctgtgtctcaggcaggtattattgaagctagttttgggaagagagctacttcagaaaagaaaggcaagtacaatcatgaacaggtgtcataatagggccagtataaaatttctcaagatggtaggaaaaaaatgtgtctacacgttaaaccacaaacttcatactgggcatccaagaagtggaccagaaccaggaatcccatgcataagggttccactggattccacactccaagcagcagttgactgttgagtcaaggttgcaagggaccagagtccacagccacaaacccagtggaagggtggggaattctgccaaagagagacaatttctctctcctccatgctaggctgtcctctgtgtttcagtggagatttcagtgaagaattcagtggaatttcttcaccctgatgttgaaattagcaggaagttacccctggataataactctgcccctgattgactcaggtagaaagaagtgagaattgtgttaccatgtaactattgttgaaacagcaaggtgaagacaaagggaaacatgaaaataagagaaagagaatgggatactgagtaacaaaggatgtctgtgagaatcattgagaggttccactgattaaaataacagaaaccaagttaagagtgaaatagcgtatagtaagtattttatgtcacctcattccatcttaatgccttggtgtaagaaatgagaaacgttttctgaaactgtaacaagcaaacagttaatggctaggtcaaagtactggaaatcacatttggcctgcagctgatttttccagcagatgacatttgctttagcttaaactaaaataaaggaacattattgctctgattgttccagcttataagtgaaattctttcccacttaaaattgaaaaattaggagcattcctggcacgtgaatgatattcagtacccaacaccagtggttctcaaatgtgccatttgagtcagtttctaaacgttgttgaaactgattgctggacccacctccaaagttcctgattcagtagatctagggtagagcctgagagtttgcacttctaagaagtttccagatgctgctgctgctgctgctcagaggaccacactggcaaccactgctctacactaatgtgaaccgtggcatgtgtctcgctatctgatgttactcttctgttttcccccattggaaacaacaaactatgaggaaaaaatatctgaattcttacactggtatcattgactggaaaaaacaaatagtcattaatttgacaattgtcatcttttaatttggtgggttaaaatctgacaggatgtgacgccaaggcatttcatccttagtggtcccttcgaggtttcacacattatttctttgctgagaccttgagagcacaattacttgccagaggttttgcaatgcaatggtgaggaatgcagaatgttgggttcagctgatggaccctgaacgctaaccagaaggcacacgtgtgcacacttaggcttagagtcctcttccaggctgactagtccaacctcagacagccacaacagtagggagaagtcccactgggcaggctcctttctgaagtcacagctgcatggacagatttctctcctacacctgaccctctggggtagaaaaacacacgttttcacagtagacatcaatagactctttcaagttaatttcatggaggaacctaaatcatcgcgtgctcatggatccagtggttctcaacctgtcctttgcatcacagtcacttggaggactcactggaaaacagcttgctgggaaccgcccccctgtttctgattcagaaaatctaggtctgattctaggatccaaaaatgtgtttctgattcccaagtgaggttgttgctactggtcttgaggtccacatttggagaactgtgggtctttatccaaaatacatagaagaattctacattgacaaagtgaagatgcttgttcccaaatgctggagatgtgtgattttggctttgtccaacaatgaaagctctacatagccactgtgtcctggagtccttatgagagatagacagttttattggttgtagaaatttgcaactttgtacaaggggcaacatttacacaagatgcacatttttatgaagatctcttctaaaattttgaataatattccatttcagtgtgcttcactaaacttgttgcaaacgtgatttcagtaatttccctactttcaattactaattgcattaaaatatcagagaaaaaaaacatactgtgcagcaactctcagtccaggaaagaatggatatgtagaaaggattttttatataattttaggtttataatagaaactatagaactgaattaaaatgtaatttctagtaaaaattcttactcttttctaaacgcaactcacacatattaccctgtaatttgattttggtacttgtatgaattctggtgttaaataggaattttctgagagcagaataaagaattaaaaaaaaaactgctctggatgctttaaccagtgcctcaaatgtaataattaatacttattcactaaatcaaagttttagctctacttcttcatgtagaaaagtgacttggaaataaacagtcagaactccaaatgtaagactttgagatgtaaagagactatctgaagctgaaatcacctgtcgggaaaccatctggatagagttctgcacttaggggattactgtaagaacttgaatatctacacccaaataattcatggaaaaagacagcggacatttctacctaggactcagtaactgttcatcaaaaggatcagggcatgggtaatatttgcctctagcaataatagacgtttccttccaccccggtccttacttaatataaaaagaagttcaaatgagggtttctcgtctgagctgagcctgagaaacaaagtgaaaggcaagcctgaggagcagtcaactctgtgtccagttcatttgtgaaatgagccccaatgaaataaccaattaaaagctccttcctgtgaagaaaaaccagcaaggtctggaaatagcagaagagccccaaccccagcacctgtcagcggcctgcggtttgagtctcaggcaagagtcacagtcattgcgtcaccaataccactcgtttcaccttaatggatattatgtgatgatggggattacttcaacatggtgcagaatattttggagaaatgaattcccaggcttcaaacacttaatatctcattgcttatacacaaagatgcattgtcgttttgaaagtcagaatatcagttatcactaaattatgtaagtaacctccaggaaatttcacaaggaaagtctcacctcacatgtgacaaatgatctggataattggagtgcccttcttcaagatccaagatttcgtcttgttgactgccctacctgctttttcatccccttccagatgccaagttcaggccgctcgaactcatttttcttgtgctgaatgaggcttgaattaaattctctaaacacaaattaaagggtatctcggcattaccaggaagatttgtgtcttgtgaaataatgggatggtttgagtcaaacgagtttgcaagaactactcaaaccaaattggttttgcccatattttaaaatcttttcacatttcacttatatttccacacaaatgcataaatcttaaagcaactagagtcagctggaaaaaagaagtgttctaagcatttaccgtgaagaacagatcgttaagaaagtaggctgaggaaaattgggaagaatgctgaaatgagtagcaataactgatgagctatgctgatctaacacactccaagaaaaagaagactagcagtcagttgacatggtgttgtttctttctatgcgttatattcgttttgcttaagaaatttcctaatacaaaataactgtgtcattcttcgtttctaactaaattcttctatatgattctctaatttaatgtgtgcccaggtttctcttgacgtttcattgatgatccagtggcaaagaagaagaaacgatactaagatggaaggagttattgtgaaaatgtacatagataaaagcaggaacttattgcataaacatgtcgttcctataaataaaaatcaaacatatatatgtaagtcttctgatcagtactgcaaatttgccctccagaaaggttatgcaagtgtgcagtccaagaagcattatttagaaatgctactaaacaggttggcattgctttgagaaataactcattattcgtttaaatagcatttttaatttagtttcattatatattgtttagttgtatttcttctttgtaatttaccattctttatttgcaaatcattttgactacaataatcaataattaatatatcaactgttataattcaatattcctgtagttaatattctcatttgccttataggtttttctttttttgtgtgagatacagggttttttttatttttctattttgcattcaatcttttcctttatggcttctgcctgtttaatcatgtttaaaactgcctgtctactgtaaaattatataaatgtttatcttaattacctcataatcattttatgacttcagtttttacatttaaatcttcaaaccatctgggttttactttaccgtggtaagaaggatgagatagagcttaatttttttccaaatgattagtaaattatcacaaaaccttttgaagtaatgatttcttcactgattgattggaaattcacttatataatacattattatttatagatgaagttattcagagacaaatttaagctcagaaatagatctaagtattggaagtaattttagaacacaggaggtgttctgataatattcaaatctcctctaaaaatttttcattgatatcacttgtttgagtatctccaagattttgatagaaagtattttttattggaagaaaatcgatgcccccactcacccacctgcgcatgtgtgcatgtgtgtgtgcacgcacatacacacatacacacaagcatgcacacacacacatgcatacacacatgagtgcatacacgagtgcatacacacgtgcgcacacacacgagtgcatacacacacgagtgcatacacatgcgcatacacacttgcatacagacacgtgcatgcacatatgtgcatacacacacgagtgcatacacacgcgtgcatacacacacgtgcacacacacaaatgcatacacgcacatacacacgcacatacatgtgcatacagacacacacgcatgcgcgcgcgcacacacacacacacacacttcttacttctctataccaaaagctaacaaagagtttctgtaaatgtttcaggctttgtggtcccagcctctctcacaactactgaactctgaggttgctattgtgggatctcgccagcaccccacaatgcaacggggctctctctttgttcccaggtggatcggcaggtcgagaaataatagacacacaagatagtgaaaactgggtccggggggtcaccacctcctggacctgagatgccaccaatgcactggatataccagcatttattattaagtttagtgagggtgggggtaggttagtgagggatttagggtcatttgattatgaggtgagatggtcacatggggatgaagtaattctttaacataacatctgtattcagaagtacagtatgcagagataagaacttacaatatagtgtgtgcattagcaatttctaacagagccttaaaacagaaacacagtctttccataacctatgattagcaagacattaatcagcaggaacagttgcagcaaaagctggttacaaacaatccatagaaacaggacgtgaagctagacaaccggtcagaccagaaattctcggaagggagtatgccttaaccctaaagaggcctagaagagctgcggcaagatgagggcgtttatagccctatcttatccatatggacaggtgccccccatgcatccgtttataggctctccacaagggtcgcattccattcccagagctatgaacatctgcttttctgggataggaatcttggtgatgtgaaacctccctgactgcacgtctgttcataggctctcttcagggggaagcacatcacccgctgttggctcattctggcagtccaacctggcattgtctttacacaatcctgcatgcaattttgtatttacaataatcaggagcatttcatcttttattctgtagcagtagtttcaggtctccctacaactccccctttactctgatttaaatgaaccatagcaatcatggcttggcgctgatcctgattggattgaagaatatttttttccaattttacacatgaacaataaaccaatagcacaaattatacacagaacaaaattaacaatagtggatcctcccaaagattttacccattgaatggggttgagattagataacccctcagagatacaaaactctgggtgacacccaatgaaccattctgttctaatcaaccttgatttttgtacattacaattagaaccattgatgattttaacatgtcaggaaaagccttttctttttctgatatttttttcaacaatttaaagatgtaaaaagcattcttagttcatgggtcatacaaaacaaatggtgggccagattcatccggtgggacatcgtttgcacttcaaatattggaagactcttatgatagactttctataatctgtagttggaaattaatgcactttttaaatataatgttttgaattggaatgggcacaaattatttgatgtgacttactatcaagttatataaacaactgaactctaaataaaaatataggctcttgagtgtggtagaagtaaacaaaaaatgtttgagtatttgtcacccatgtaaataaatttatgcatccttcaatgttgctgtgaaatatttggccatccaggcaccaggagcaatacaaggaggtatttagctttcatttttgaattaaaaagtaggacattcaccagaggaaacataatttagaaggaaaactttaagaagaattggctttaacagatggattctgttttgggaatgatcatcaatgtaatagacaatgtattgtgaatgattttattttacaactttttattaaaatgtactatattggaaatcttatattaagaatgcttataggtcaacctcgcttttactttagctataacctaatgtttaataattatagtagttttttcattaatatttcggtcaacatattttaagctagattattaggtttaaaggactgaattcatgttaccatatattgaagccctcgtttcataaataaagcttattgtcttaataactcttttgtctgacattaatatactgctataataactcttttgtctgacattaatatactgctaaacttttgatcagtttatcctattatttttattccatatcttcaatttttctcttatattttagatatgcctctcttaaacagcataaatctagattttttttacatttcatctaaaaatttcaatcttttaagtttatatttaaccatgactgtaattactgatacactggaattcttctatttttgtgcttttcatttatctgtcatactaggctaagtgtttcttcttttgctttactttataaaccaaatcattttcttttctccactagtataaggtgaaatattctatttctgttctcttgtggttacggtaggcattttgatatacatatttaatgtaataagttaaaatataatcaatttctttttcaaattaaccatgactttagactattttaactctaatcatattcatccctctctttgccctaaatatatttctgtaatgcccaggtttgaatgcaccttgatttaattatactttcattattttggattatttaattattttgattaaataatttcatctaatgatttactgttttctgtctctctgataaatacataaaagtagaaaccttgctcataagttagtgtatgtttaactttatgacataatacctaacatctttccaaattagttttatttgtacttttccccactagcacagcaatgtaggagagtgtcaggtgccccacatcttcgtcaacatttggtgttgtccattttaattttagccattctaatgagttttaattattttctctgataacttataatgtcaagcagcttctttttctcctgtactactggcttttcaaattaattattcccagaagtgtctgttcaagttctttaccatttccttattggttgatttatcttttggctattgatttgtagaaattatttatgtattctggatacaagtcctttgtcagatatatgcaatgtgttctcccagtctgctctttattcttctttctcttaatggtgtttttgatggacaaaggttttttacattgatgaattcaacttattaatttttttttgtatttccttctttatgtgtcctttctgggaaatgtatttaaacttattttatggcccggcacacattctaccttggtgaaatttcatgtatgtcatttttttttctgcctcatccaatctctattcttcttctgcaattccaattatatgtgtgttttacacttgacactgttctagagctcaaggtggcttggttctttttttttttttttttttttttgagacagagtctcgctctgttacccaggctggagtgcagtggcgcaatctccacttactgcaagctccgcctcctgggttcacgccattctcctgcctcagcctcccaagtagctgggactacaggcacctgccaccacgcctggctaatttctttgtatttttttttagtagagatggggtttcaccctgttagccaggatggctaccctcgtgatccgcccgcctcggcctcccaaagtgctggagttacaggcatgagccaccgtgcctggctggttcttttttaaaaatattttttcctctctatttttcagatttgacaatttgacttgttgctttatcttcaagtctatagactattgatttagccatctccaactgatgttaagaatatctgtgattttttaaaaaattcagatagtttctaatgttagaatttccattagtttgtttttatttttatttttttaagtgaaagcaggtttattaagaaagcaaaggaatgaaagaatggctactccataggcagagcagcctagtttatttttatactgtatatttccctgctgggattatccctctcttcactcacttatggctattttcccttttacatctttgaccatatttataatagtggtgtttgattctttgtctgctaattccaacatgttgatgatctcagtattggtttctattgatgtttgttctcttgactatgcataatattttacatttctttgcatatatagcatttttgtattgtatgctatactttggggatgatgcattctgaaaagagagtggattttgttatcttttgcagattattcatttttgttttagttaacagttacattcagggctgatcaccctgaatttatggagatttggttttgtactttattggggcaggctgtaagtatggaccttatagaattttagcagacactccaaagtgtctactaagcccctttaatttgaatggagttaaaatctaaattgtcttcctctgatgggcagcaattgaaatctatgtccagtttttttcatccatctatcgccttctatagggctgtttggtgttttttgcatgcgtctgcagttcagtttaactaaatatttatggggactttatatgcagacttttgtcccctcccatttctgggatttcccatctcaattcacagccacgttggcaatgtcacactctcttctctgttacctaaagccaacaggcctgtggttttctactttctcagtagctgcctgcctcacgtgtactgggaaccttgccaggcccaacccgcagacactggtcaagcgacggatgaaaaaatgtacgcagacacaggttttttgcctggtcgggcggataggggaccgggccactcagacatcaaggatgccataaagagtcacagcggctgaggccctgacaagctagcgctgagggcatttatttagtacagatttaataacaaaggctttgagtcaacacacttgtgggtaattaacatggtcgcccccccaccaatcccccaacccctacccccaccccagtcctcaccccgctccccgagagagcagtcctgcacgtggatgattaaaggccaggttctaaggcctaagtaaactaacttatctggatcaattcccttacacttccttgttatctgctcttagagaattcagctgccttttgccataattttcttctgaagttctgcaaacccctggccttctgagaaggtctgcattctctatctataatttttcccaccaccctgaccaatctcctacagaacactattgggaatctgtataaatatgggtctaacttagtgcatttctgtcttttcaagggttcagcttaactatacttttagcaattctctacaactgtcaaatggttttctttttaaaaaatttcccagagattataagtttagtttgatgtaggctactttatcattatgaaacccagaacgattcaaatcattattatagttcacaaaatctctcttaagctgtgttttatgtgttgttatatcaatcctttaaggtttaatttttgcttttgctttttatctttttatttctatgcattctactgggttactactaatttggctcaggagttttgatagtctcttgttctattgtcatactttccattatttcttttttctttaaatacattaaacagccattttattcaataatcccattgttttccatatcttaggtctaatacataaaagggttttttaactttaatttatgatggtttatgtctttatgtttatttgagatatttttattgtaagttccctacccctagggaaattaatctgtaggaattcattgagcatagaccttaaagtgcttgcctacagagaaaaacttattttcttctactgaaatatgggggacgtatccaaaattggattgccttgcattaatgtttgacttgatgttttataggccacacagttagtacaaatggagaccctaaacccagaggtggttagaaataattaccagagacatatatgttttctttttttttttttgaatactctgtagcttattgagactgaagcagacaattatacccacaactccctctgcagaggtgctttcctggttcacctgctgaagatgtcgtccttgctgggttctaacttgggcccttatcttccagccagccccccttattgcttggaaccaggatttgtctcatttcctgatgctccataaaaccctaggtaattctcccatattaactcccattaagccacctatttaagaaagaagaaccggttaatattttatccatcttttttttgaaatgccataaaaactaagttattccaaaagtctatttagcaatttttctggaaatggaagttttcctactggcttttgttccatgtgtttcaaggctgggtttttaagtacatacaaattttgacttttgaaaatgttctttgagaattcttacatcaccaacatgcagtattcttccttgtgcattacattgctatttacttgtattccactttgtttcatatacattttggcaaacctatcttctttttgttaacattttcttagtattttctttacaaacattttcattcctcctgtatcattttaagtgtcttttattgagttaaaaaatcaattaatttgtattctgtgcacaagaatccctctattatttaatagataaatttggacccattcataattattgagaatattaatattttgcatcatattcttgttccattattttgtgcctccttctcatgctttccagttactcatttttcacttttatattattacctgttgccgtataataatattgccaaacttattgccttacaacaacacacattagttttctcagtttctgtggtcgggagtccagacacagcttaggtggctttgctgcttcagggcctcacaaggctgcaatcaagatgccagccaggactgtggccttatcttaggcctggctggggagagatctgcttccacactcctatggctaatggtggcattcacttcctggtggtttgttgggctgaggggctccatctcttattggctggggggtcaccttctttcccatgtgggctctctgtatgacattacacaacatggtagcttgcttctgcagagccagcaagggagcgagtctactgccaagactaatgctacaacttcatgtaatgcaagcatacatacatctgtaacatcttccatattctattggttagaaggaaaccataggtcctattcattctcaaggagaaggtatattagtctgttctcatgctgctaataaagacataccctagattgtgtaatttataaaggaaagaggtttcattgactcacagttccacatggctggggagtcctcacaatcatggcagaaggtgaatgaggagcaaagttgtgtcttacatggtggcaggcaagagcttctgtaggggaactcccagttataataaaaccatcagatttagtgagacttattcactatcacaagaagagtatgggggaaactgcctccatgatttggttatttccacctggcccagcccttgacacatggggcttattagaattcaaggtgagatttgggtggagacacagccaaagcatatcagaagacatcacacaagtgcatatgtcccaggaggtaagaatcctggggctaccttcaagtccatctaccacatttcttatatcctttttaggacagatatcatttttttcctgtcacattctttaatggtttgaaggttatttacttgttaacatttctatttacacctatattttcccgacaatgtctagtgctgatcagattatatattcttcccttgaataaaccatataaccttagcaagcgtggagtttctttctcacctactcccactttcgccatttgccctttgactatttggtatttggaattctaagctgagaatttaaaaaatgtaaacataaacaatcagcaattatttgccttaaaactacattttactaaattacttgctgacttttcattaaacccactcattttctcttgggtttactttgtacatttcaaaatattgctgtcctcctctcattcctggatggtaccctgattaagtatagaattcttgattcaaggttattttttctttttgaatttttgaaatattactcccttcaccttttgtctgaaacattatgtctaacctactccatatgccaatctgatttttgttcctttgtacttaatcggatatttttcacttttgtaactttcaagcattttctttttatctttggctttctgaaatttgacaatttgatattttaagtttttgttttatattacttatatcttggtgtcctgtccatttataaagaataatttcaatataagtagatttattctccaagatctagagaagtttctttggttattctttgaatattctcctccatctttatttgctttttctagacattctttcatatagtactaatatcacaaatcccagatctatcttctatgtttttcatgctttctgaactttttcattgtttgactaagttcttgaggaattccaaagggtaatttcattgctctgtaatttacattttacgtatatcaaatggtatttggctgatacactaaggttttctctcaataaaatttttactctgcatgatttctatttgattttttacatctattattctccctcccatctctctgtgatgctacttatccttacactctgctttgttctttgattgtgtgttattcagcctttggagtttgttatttcatggtggcttctccctttcagtgctagatgaatcttggtaatgcattcagcagcattttctgttaggctcgatgtcagcacagcctggctgggaggagcagtgagatgtgctggagtggttcattctctcttccggcaatcatgctgtactagactgttgcgttgctctaaagaaacacctgagactgggtaatttataaagaaaagaggtttaattgtccccgagttctataggatgtgtggtgctggcatctgcttggcttctggggaggcctcagggaacttagtcatgatggaaggcaaagggggagcaggcatctcatatggccggagcaggagcaagagagtgggagctgccatacacttttaaaccaccagatctcatgagaactgactcactatcacgaggacagtaccaagggggaatggtgttaaaccattcatgagaaactaccctcatgattcaatcaactcccaccaggccccacctccaacactggggatcacaattcaacaggagattttggcagggacacagttccaaaccatatcagatgcacacgaaggacatacagtacacattgtgagccatgacaaacacaggtttatgtctgtgcttatttatgaaaaaaatagtttacttaccaaacacttatttatcctcttgtgaaagttagtattaatcctcttgtgaaatgaactctggtattttctattctgctcaatcgcattgcacttttttcacacacgagttaagtacttttttgattttcacacaccaaaatgcatctcgactgtggttgataaatactattttaggccattttcagtaaaattaaggaagagaacggacaagctatgaagtgaggagtatcaagagctaattttcaacatgtgggcacccctctatctcctggtcaaccccagccatttgtacacaatgccccatctctctgcataacacccaggctaattttacttaaaagagatacagctctgttgtttcagcctaggcacaaaaggaaaagaggaatcacagaggaatcaaatgcatggctataatgtcctcactaacatctttcaatttacccttgacccctcttctctgtctgtctcatcaggaagtgaagcatttcaggcttgctcccatgtctatagctgttctgcctgtgcacgtttgatatcattgcatcttcaacctgatctcgttcacttctgtttcagaagctactagtaatgtctgttctaccaagaattctcccttggattttacagtgttaaactgtatttatttatgtctgttatgtcatttctggggcttgaggcaggatgggtagctataatgtgtttggtttactcccttgaactagaaacctgggctatctttgccaagaaacattgttgtcaaccagaatttttgctgatttaaggagtatgctagtcttttatgatataactaatggaagcttctattaaggaaatacctctgtgacttgtactaggcctggatggaaggccatcccatcagagcttggaagtacgccgtgagacagtgctgatagacagagtgaaagtgctgctcaggaaaggaactcctggatctatgggtctcagtggacatggcagaatcatgcaattcaaattcaacttaacaagaaaacattgtttgctaactttaaaaaaatagttattcttttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtcatgcctaggttttcttctagggtttttatggttttaggtctaacgtttaaatctttaatccatcttgaattgatttttgtataaggtgtaaggaagggatccagtttcagcttcctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtacaagtaccatgctgttttggttactgtagccttgtagtatagtttgaagtcaggtagtgtgatgcctccagctttgttcttttggcttaggattgacttggtgatcgcaacctactcatctgacaaagggctaatatccagaatctacaatgaactccaacaaatttacaagaaaaaaacaaacaaccccatcaaaaagtgggcgaaggacatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcatccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaagacttggaaccaacccaaatgtccaacaatgatagactggattaagaaaatgtggcacatatacaccatggaatactatgcagccataaaacatgatgagttcatgtcctttgtagggacatggatgaaattggaaatcatcattctcagtaaactatcacaagaacaaaaaaccaaacaccgcatattctcactcataggtgggaattgaacaatgagatcacatggacacaggaaggggaatatcacactctggggactgttgtgggttggggggaggggggagggatagcattgggagatatacctaatgctagatgacaagttagtgggtgcagcgcaccagcatggcacatgtatacatatgtaactaacctgcacaatgtgcacatgtaccctaaaacttaaagtataataaaaaaaaagaaataataaaaataatacctataaaaaaaatattctttttcaatattattttgtttattaagttccttgcttttccatatggattttaggatccactcattaacttatacaaacaagggagcggggattctttcctgttcttatttatttgtgtgtctccattttctcccttgaaaattggacatttaaaataatccactgcgtgaactttggaaatcagatttccccctactttttactgtttgctgctgttgttgttctttgtttagaaacttcatgcattaattttggaaattctctattctttttcacatgtggtcatgaaggctttggttagcttagtgatcagctgatgattagacagagatttctagtcttattgatctggaaccaatagggctcccaaatctaccagtgtacttctgtgtgtgtttgggcacacctcaacactcagccagacattggacaactctgccttagctctcccttcctgcttaggaagtgcctcaaggtcagacagaggtgagagcttagagtcttcagtcattctttaccatacctacatctctgcatatgtacttggccttctagattcaaaaaaaaatatgatgtaacttttcaacattcctgtggaaactgcatttcccagtcttaccttttaagctttttggttagtctagggtttctcccaactattatgtagtgccataggtgactcagaagttaaacaattgcctcaatacatccaacagtgtcccccaagtcaaaggctttctgtactgggcaagcaccaaatcacatcatataagcacagctttgtgagcaggccctttcagagaactatcaggcaggtcagatcatgacaattctctggaaatgaggcacctcactgaaggtacctcaccctgttcctgccactccagtggcagctaggttggtggttttcactgtgtttgcagacaactggttacaaagactaccacagagctaggggtacggttgaggatgggaacaggaaaagttaaaacactacaaggtcactggtcttaccaaaatttggccattttcctggagtaaatgttctccagatttgtatgaggctttggttaaattccgtgtttctgaaaagttgattctcacaatttttgtcagtttttccatgacatttaagaggagaaaatattcagaggttcttcctctgccattttcattgacatcctatttacttttatttaattcataatattatgtacaaaaaatatttagtacacatctggggtattggctatgatcaagagaatagcttagtcctaaacataaccataagttaagaggaattctttactgtgggatttcatatctggtcctgccctatggggcagtttactgtgagtttacttacctctgagcctttctataaacacacctgccccatatcccattctcaagggatctgtttgctaacttaccaggtaattaatttagggtcaagtgctaatgactcataatggcataatatgtaatcatccaaatcacattttcaggatcgccaagggcttctgtatcttaatccaaaataataagcaatgtggggattattggctccttaagaagatcaatctctcttacatagaatgagctctgaaccagacacttagcctaagacaagtcagggtgatttgtggagttgaaatgtttttcactgaaaatgccagaatgttacttttttcaaaacgtctgaataatgttggatttcctatcgcctctaattcattgtctctgtttactttgcaagtatagaaaatattgatgaaaatgatcatcaatatgaaagtaaaatgctccaaattaataccttttttctatgacaaagaaacctttacaagtggaaataacttgtatcttcacaaggccacatttttaggtcacaatctggactaaagattttatctaaaatttttaagcatttatctttgcaaaatagttaagcacaatttttaatagttatttagaaaacattggccataaccctaatctatacttattaatatgtgtccttagaactcaaaggttttctctctctctctctctctctctctctctctctctctcagcatgtgtatataaaattgctggtgctagttgctatggtcaacatttaaagtgctaagcacaacacgaaatctaaaattctgtcagaaagaagctatttctaccacttgaaaaatttcctctctgcgcagacactgcttacagctttctggcatgtgacttaggaacaaagccatgattcttttaccggagaaggtttggggatatactttgaatgttaagttatttgggatgatgttttttgtcatttgatgccagctgccactgttcatgcagaattgagatatcagttaaactaaagcagatgcaaaatagatattatatctagactaagtatcatgcttagaatataaacacatatctacagtgcttttttataaagataaggctatgaatattttagtaatgtttggttttcctgatagaatttagatttgatctgcatagtgctaaaacctctttaagaacaccaccacatacttgggttttgtgattatttggatatgatcagggttaggttgtcctttccgtaaatgaagaacaggttgaagaaatcaattgtataaaaatgttataagtggagttctcagttgactccactttcctctagctctaaatttgtgatgatgtgatctttttgcaagcaccatttacatactgatgtacttgttacatttcattctaattagtcattaacatatgtcttctaaggacagttgaggaagcattctcttaccagaatttgttatgagttttttgctttttcttgtttctctttccccttctttcttcaaaatgacaagagagttttctttgcagtcatttgaaagtggctcagttgagttagagtgagctcattaattgtagatttgtggtaaccataactaatttttgaggaaggcatgacacagatgactgtatccaccagaaacaagtttcttattccctgattcaatcacccaggggattggttctgctggggcagggtgaagggaacagttttcagggtgtcaggtaaaaacagagacgctagtaacggtgtaaacacttgtttctccagggaaatatctggacctggctcaagacgggactcttgttcttgactttcctccttcctgtgtcttctcagattctcagcccagtgatgacgctgtcctcccactctgcattccctagatcacacacaaggctgtgaatgcttgtgtacctcatgtgctgggcatttccaagaaccagtggcttcctgtgaaagctgattcacaagtatgttttcagcttactgtgtgagcaattaaatccactgctgtcatccacagtaaaaactctccacatgctgcttcacagacctttttttccctttggctttaaacagagatgtttaatgaagatgagatttttatttccttttccatatataggagctactgaatgtaagggagaaagaacatggcttaatatggtgaaagtaatggaggcagtatataattatcattatctgctacaattaaggcagcatcacgctgtcttgtgacagtttattgtggtgtgtggggatgcagtaaagtgatatttatacccccatgactgccttgccattcagaaatccataactctataaatgcattctgtggctatagagcatatgtcttcagcacttccctattaggctgggtctttacattgagaatgtggcccatgaaatgagaataagctcatagaatagatcagaaagtaaaaagctgttcaacagcaatgatgaacaaaaccttcacctgtgcaataagggtgttgggatctattggtaaaaggcctggggcccgtctggtgataggccaggaccctgaggcagggctggataagatggagagggctgcattgcaccatgcattgcagaagaggcacactcatttcaagaaaggatacgggcttggctgagcgacacatgcaactaaaactcaagacacacattctaactttctctcaagctggagtcgggaggctggcatacaaagaggacaatgtaaggctagttatcacatgccaatgacggtggtgaagaaccacgtgttccatgagacgtggctgtctagaccatgttgtgcagaaaaaaacttgagtgagacatgggagctgaaatcagtgttctgagctggacaggacagaacctctaagacaaccaaggggcatttgagtgctggctttgccagagcaactagtgtgggcatcatcctgtttactgcctgttgcatggagacatgatggtacccactggatatggctgtggctaagtgtattattccgttcctacgctgctatgaagaaatacccagactgggtaatttataaagaaaagaggtttaattgactcacagttctgcatggctggagaggcctcaggaaacttatgatcatggcagaaggcacctcttcacagggtggcaggagagagaatgagtgtaggcagaggaaatgccagatgcttataaaaccatcagatctcgtgagaactcactcaatatcatgagaacagcgtggggaaaaccacccccatggttcaattacctccacctggtcctgcccttgacacagggggataattagaactcatggtgagatttgggtgggaacacggagccaaaccatatcactaaggttcgcttaactaatgtgtagaaagggttcagggcaatgtctataacatagctatcactcaatttaggttgctgttattattatcattttcatgatagagttattattattattccagaacagccaaagcctgcaccatctattccagcatatttcgagatttaaaagtacaccactatttcattctaaaggaatgacttgccaagatttaaatttcaagtactttgacacctaggggaatctccaccatgttggggctgcagggggtacaaggcccctcattgtacccttctggtgcctctccaccctgctcagtgccccaggaggctgactggcagaagctccattgccctttggtgtttgactgtgtttggccagtgggaggcactggaaggagttgcaggatggaagggaagtgaggccagagcgtttgcacccaactccctgcccacccattccctgaaccagagctagaacttccaccaggcagccttgccgttcggccacccttcccgggttgcagggcctgctctccttctgcatcttcctcaagcctagaagggggaatgccttcccaatgacaagccccaggtactgcactatccttgggtggtttccctaaatcttgcccatgccttcaaaaaaaaaaaaaaggggccctgtattaaactttccttcacttcccagtgtgagtgtgcttcctgcctcctgccgtgggtacttcctgttgtcctttaaatcacacctatataattgtttccatgacttcaaaactatttatagcatactttacctcatccctttctgttctcaccaactaaaatagcttatattttaacctttgtcatagagacacacaaatacacacctagtacctaaacaaagcagaggagaggcaagttaatcctctgtgcctacgaatatgttaatttttaaaagcattactgagatgcttagtaaagtagcaggtgttgtgaaattgcatttttattacccttccccatatcaggcaagaaagttatggtctcttcagctattttaccatttgctaaatgttcccagtcagttagcacagataatgcttttttttaaaatcatatttaggcaattagaaacttttgggttaattaattttgcatattagaagacaggactttaatataaatttaaggcaacgggtttaatattgtaaataataacagttatcacaaaccataaacatatttataatttatatgcatgaaaatagagtctgctgttaaaatattgaaaattaagataacacagctttcagcctcaaaatgaaaactttctgcatagctacactctctaagtaagacatatttggccaatgacttaatataaatgaatggcaattctttattcagacataccattattttctaatgcatgtagcatattcaaaagatgcatatgtttccaaaaattataccatcaaatgtgataagaaaggaagttatgatgaagggtaaataggagtgggagaacaaagaagccaggaattgggtttgaaagtaatgtccatgtcctgaaggcctctacaatgagctatgcatcctcccttttttatcatattcaatggtacaatttttggaaagatatgagggaaatgcaattggctaccctatgtttattatctagaagatgaaaataaccacctagtcaggtaatgcagatttcttcccagcaccaagataaagagatgtttactcattaatgagacactgtggcaacggaaggaaaaccaagctccacaggagcattcatctgatttcctaagactattttatttattgagctcctcaatgtagacagatggagtaacccaaacggcaatttagtggtagcaattctttggggggaaaaagctgagaatgttgcaatccaggtaaacatctcgatgatggctctaatgattgcagctgtcaattaactgatactcccacatttttgttgcaatggcagagaatatgaaagtcctaaggacaaaaacagcaaaccgtccttgagaatttacatgtggaagatgagagcctgagcctgtggggcctgactccaggctcccagaggcaacatgtggctccatttggacttcagaaaagcaggggaaaagaatgacgaggaggcacaaaagttattttaaaaccaggatgtagttgtaacaaatacagctggaaaagaggaaatgagatttttaaaatacaagaaaagatagcgaaaaagagcctctgttcccgttaatacctcctactgtgctaccaaagttcagggattgcaaatggctgtaatcatttggccaccgccatggactggcctgttagcagcaaagtcaggtctgatggcaggttccactctgacatctcagctccatattttagggttatttgcctctcaccttgaaaaacacctactgcagttaattattaactgtcaccttcacatcacccagagcgggctgatgttacagaacagcctcagccaactctcatctaaactctgggtttagttttctagtttttgttttgttttattttgtttcaggcatcatacctaaataatgcctaaacatctttctcctagtaggcagattattttttccttctaaatgtaattaaagatacaaactcaggctgtgtttgtgcttgccaagaaaagaacaagctagatttggtggccttcacagtattttttttagtattttaggtttctccattatctcaataaaagtccattttaatacattgaaatatttgaaatatatttataaaaattatgcgttaagtaatttagaactaaacaacaaatcggtaacatataatactatttaaagcaaatatcatcaagggtcaatttccttaatgcaaaaaaaatcatgcaaatcaatacgtgagaaaagaaatagaccaacagggaaaaatagataaatattatgagcagacagtttacaggaaaaatgatatataagaagatgcatatatcttaaaatatattggttgaataatatcctatcttaaacattttatttctacttaaaccatataaatgtatacttgctaaccgatcttttgacatagtttttcatgtttctcttattatataactctacccatcatgtattgccttttatttccaattttgatttcatcaaagcatagcaaaacataaaaaccttgtaagcactgacaatgatggtttccagctttacccatgtccctgcaaaggacatgaactcatccttttttatggctgcatagtattccatggtatatatgtaccacattttctttatccggtctatcattgatgggcattggggttggttccaagtctttgctgttgtgaacatgtatgccaggacttgtagtaaacaacaacaacaacaaaccttccaagtgcaaaatctctgtagatttttccttttttcccctcagtctttttttttaacagctttgctgaggtatagttttcatagcataaatttcactcattcaaaatgtataatcatccagcctgagcaattggttaagactcccatctctaaagaaatttaaatgaaaaaataaatacgacgtggaaatcaatgatttttttagtatgcttacagaattgtacacccatcgactgaatttaattttagaacatttttgtcactccaggaagaaaccttatgcatattagcagtcactccccacaccccttcctcctactccccagaccaagcagctgctgcttcctgtctgtgtagattttcatttccctattctgcacgtttcgtataaaaggaatcatgaactacgtggtctttcatgactggcttctttcatttaggatgaaatgttttcaaagttcatccacgttgtggcatgtatcagtactttattccctttagtggctgaataatcttccactgtatggatgtaccacattttgtttatccgttcattagtcagtggtcatttgggctacttaccctttttgactattgtaaataatgctgctctgaacatttgtgggtgtgcaagtgtttatctgggcatgtgttttcatttctcttgggtatatactcaggattgaaattgctgagtcaaatggtaactccatgtctaacattttgaggaacgccagactgtgtttcacaacaacttcaccattttaacagtcccaccggtaatgtatgggttcgaatttctccacatcctttgcatcacttgttattatctgacttttttattatagcaattttagtggttgtgaaatggcaactcattgtggctttgagttgatactcccttgtagaaaaacaagagtcaaacttacgttttaaaaaatatatgcttggggccgggcgtggtggctcacacttctaatcccagcactttgagaggctgaggcaggtggatcacctgaggtcatgagttcaagaccagactggccaacatggcaaaaccccgtctctactaaaaataccaaaaattagctgggcatggtggtgggcgcctctaatcccagctactcaggaggctgaggcagggacaattgcttgaacccaggaggcagaagtggcagtgagccaagattgcaccactacactccagcctgggcaacagagcaagactctgtctcaaaaaataataataatacacacacacacacacacacacacacacacacacacacacacacacacacgtgcttggggaacttttaacagggaaaatataatgtatgtgttatgtaggcttcagccacagatacatgatgaagcttacaactgtaaacatgcaggctttactcttcttgattactgagatggatggcagtttatcgacacttattcaggtttttgctcctttctgtcaatttaaatctcaggatcagtgaaaagagcccagggagaagacaggagatctgtgtgtccccagccctgtccccaaactgtctgtaagaactttcagcctctgaaactcatcagcagtagaagataacttgtctccaatatttgacagtggtgatgtgaaggtaaagcaaactgattaacacgaatcaactatgaaaaacttaaagcgatttaccagcatcttacatgtagtaaatgtattttacacacacacatatctattatattatatatacaggaccgaaagaataaagaaaaacattttttgggtaggaaaatggcagagacgacagcaatagcagtattttctggcaaaatgttacagaataagatggagtatacagaaaagtaaggttactcattcaaaacaacaaccacagatattttttgttgatattgttaggtttgggatttattttttagattttaatgaagatggtaggttaattgataaccttcttggcaggagaccataatcttggctttcagaatgtgaataaaaggggctctagtttctttcccctttttgtaatatcgttgtcacctcataactacagcttggggttttagctacagtccaaatgacattttaattaataaaatttggccataattaaattacatataaaaatatatcacaagtacctcttatttaacttttacttctttgccaatatataaagtggtcaataagacttctattcaaaaatagtgtattttttaaattttattattactatatttaagttttagggtacatgtgcacaacgtgcacgtttgttacatatgtatacatgtgccatgtttgtgtgctgcaaccattaactcgtcatttagcattaggtatatctcctaatgctatccttcccccctccccccaccccacaacaggccccagagagtgatattccacttcctgtgtccatgtgttctcattctccatttcccacctatgagtgagaacatgtggtgtttagttttttgtccttgcgatagtttgctgagaatgatggtttccagcttcatccatgtccctataaaggacatgaacccatcattttttatggctgcatagtatttcatggtgtatatgtgccacattttcttaatccagtctatcattgttggacatttgggttggttccaagtctttgctgttgtgaatagtgccacaataaacatacgtgtgcatgtgtctttatagcagcatgatttacaatccttagggtatttacccagtaatgggatggctgggtcaaatggtatttctagttctagatccccgaggaatcgccacactgacttccacaatggttgaactagtttacagtcccaccaacagtgtaaaagtgttcctatttctctacatcctctccagcacctgttgtttcctgactttttaatgatcgccgttctacctagtgtgagatggtatctcattgtggttttgatttgcatttctctgatggccagtgatgatgagcattttttcatgtgttttttgtctgcataaatgtcttctcttgagaagtgtctgttcatatcctttgcccactttttgatggggttgtttttttcttgtaaatttgtttgagttcattgtagattctggatattcaccctttgtcagatgagtaggttgcaaaaattttctcccattctgtaggttgcctgttcgctctgatggtagtttcttttgctgtgcagaagctctttagtttaattagatcccatttgtcaattttggcttttgttgccattgcttttggtgttttagacatgaagtccttgcccatgcctatgtcttgaatggtattgcctaggtttccttctagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattggtcgatatctctgttttggtaccagtaccacgctgtttttgttactgtagccttgtagtatagtttgaagtcaggtagcgtgatgcctccagctttgttcttttggcttacgattgacttggcaatgcgggctcttttttggttccatatgaacattaaggtagctttttccaattctgtgaagaaagtaattggtagcttgagggggatggcattgaatctataaattaccttgggcagtatggccattttcacgatattgattcttcctacccatgagcgtggaatgttcttccatttgttcatatcctcttttatttcattgagtagtggtttgtagttctccttgaagaggtccttcatatcccttgtaaattggattcctaagtattttattctctttgaagcaattgtgaatgggagttcactcatgatttggccctctgtttgtctgttattggtgtataagaatgcttgtgatatttgcacattgattttgtatcctgagactttgctgaagttgcttatcagcttaaggagattttgggctgagacaatggggttttctagatatacaatcatgtcatttgcaaacagggacaatttgacttcctcttttcctaattgaataccctttatttccttctcctgcctgattgccctggccagaacttccaacactatgttgaataggagtggtgagagagggcatccctgtcttgtgccggttttcaaagggaatgcttccagtttttgtccattcagtatgatattggctgtgggtttgacatagatagctcttattattttgagatacgtcccatcaatacctaatttattgcgaatttttagcatgaagggttgttgaattttatcaaaggccttttatgcatctattgagataatcatgtggtttttgtctttggttctgtttatatgctggattacgtttattgattttcgtatgttgaaccagccttgcatcccagggatgaagccgacttgatcatggtggataagctttttgatgtgctgctggattcagtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagctcctccttgtacctctggtagaatttggctgtgaatccatctggtcatggactttttttggttggtaagctattaattattgcctcaatttcagagcctgttattggtctattcagagattcaaattcttcctggtttagtcttgggagggtgtatgtgtctaggaatttatccatttcttctagattttctagtttatttgcgtagaggtgtttatggtattctctgatggtagtttgtatttctgtgggatcggtggtgatataacctttgtcattttttattgcatctatttgattcttctctcttttcttctttattagtcttgctagcagtctatcaattttgttgatcttttaaaaaaaccagctcctggattcattgattttttgaagggttttgtgtgtctctatttccttcagttctgctctgatcttagttatttcttaccttctgctagcttttgaatgtgtatgctcttgcttctctagttcttttaattgtgatgttagggtgtcaattttagatctttcctgctttctcttgtgggcatttagtgctataaatttccctctacacactgctttgaatgtgtcccagagattctagtatgttttgtctttgttctcgttggtttcaaagaacatctttatttctgctttcatttcgttatgtacccagtagtcattcaggagcaggttgttcagtttccatgtagttgagtgattttgagtgagtttcttaatcctgagttctagtttgattgcactgtggtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagagctgagttcaattcctggatatccttgttaactttctgtctcattgatctgtctaatgttgacagtggggtgttaaagtctcccattattattgtgtgggagtctaagtctctttgtaggtcactaaggacttgctttattaatctgggtgctcctgtattgggtgcatatgtatttaggatagttagctcttcttgttgaattaatcccctcaccattatgtaatggccttgtttgtctcttttgatctttgttggtttaaagtctgctttatcagagactaagattgcaacccctgcctttttttgttttccatttgcttggtagatcttcctccatccctttatttggagcctatgtgtgtctctgcacatgagatgggtttcctgaatacagcacactgatgggtcttgactctattcaatttgctagtctgtgtcttttaatcggagcatttagcccatttacatttaaggttaatattgttatatgtgaatttgatcctgtcattatgatgttagctggtgattttgctcattagttgatgcagtttcttcctagccttgatggtctttacaatttggcatgtttttgcagtggctggtactggttgttcctttccatttttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccctattctcttctggcttgtagagtttctgctgagagatcaactgttagtctgatgggcttccctttgtgggtaaccctacctttctctctggctgcccttaacattttttccttcatttcaactttggtgaatctgacaattatgtgtcttggagttgctcttctcgaggagcatctttgtggtgttctctgtacttcctgaatctgaatgttggcctgccttgctagattggggaagttctcctggataatatcctgcagagcattttccaacttgattccattctccctgtcactttcaggtacaccaatcagatgtagatttggtcttttcacatagtcccatatttcttggaggacttgtttgtttctttttattcttttttctctaaacttctcttctcgcttcatttcattcattttgtcttccatcgctgatactctttcttgcagttgatcgaatcagctactgaggcttctgcattcatcacataattctcgtgctgtggttttcagctccatcaggtcctttaaggacttctctgcattagttattctagttagccattcatctaatttttcccaaggtttttaacttctttgccattggttcaaacttcctcctttagctcagagtagtttgatcttctgaagccttcttctctcaacttgtcaaagtcattctccatccagctctgttccgttgctggtgaggtgctgcgttcctttggaggaggagaggctctctgatttttagagtttctggtttttctgctctgttttttgcccatctttgtggttttatctacctttagtctttgatgatggtgacgtacagatgggtttttggtgtggatgtcctttctgtttgttagttttcgttctaacagacaggaccctcagctgcaggtctgttggagtttgctagaggtccactccagaccttgtttgcttgggtatcagcagcagtggctgcagaacagcagatattggtgaacctcaaatgctgctgcctgatcattcctctggaagttttgtctcagaggagtacccggccgtgtgaggtgtcagtctgcccctcctaggggatgcctcccagttaggctattcgggggtcaggaacccacgtgaggaggcagtctgcccattctcagatcccaagctgcgtgctgggagaaccactactctctttcaaagctgtcagacagcgacatttaagtctgcagaggttactgttgccttttgtttgtctgtgccctgcccccagaggtggagcctgtagaggcaggcaggcctccttgagctgtggtgggctccacgcagtttgagcttcccggctgctttgtttacctactcaagccttggcaatggtgggcgcccctcccccagcctcactgccaccttgcagtttgatctcagactgctgtgctagtaatgagcgaggctccgtgggcataggaccctccgagccaagtgcgggatataatctcctggtgtatggtttgttaagcccgtttggaaaagcgcagtattagggtgggagtgacccaattttccaggtgccgtctgtcacccctttctttgactaggaaagggagttccctgaccccttgcacttcctgggtgaggcgatgccttgccctgcttcggcttacgcacagtgcgctgcacccactgtcctgcacccactgtctggcactccccagtgagatgaacccagtacctcagttggaaatgcagaaatcacccaccttctgcgtcgctcacgctgggagctatagactggagctcttcctattcggccatcttggctccaccccaaaaatagtgtattttagacagtttagagagtcattattccatggttcagtatgaaccttctttttgctactgtttgtaccttttcgtcactgtgacttcatcaggaacaagaatttcatccctgcagcaaacaccgctgcgaatatggactgcagggtgacaaaatcatcgtcacaatttttacgctttctgaatttctcttgcaaatatccacattaacagtactaatattcttcagccttcaaaactcatgctgttttatttctcacacttgcccttcattctctttgtaatggatccacaatcgttccatctgtaatgttttgccttaaaagagcagtttttttcccaagtgtcttcaagaaccatttgtattagcatcaactgggtacatgtacagaatgcaaattcataggcctgaagctagacctgctggatcagggtatggcctggtaatgtgtattttcataagcatccaggtacctcacaggtgcacttatatcttgtatatactgctatggaaggtgctctgctctaattaatcaaacaagtatgtaatagagtaagcctcatagcataataaataatactgtgggccatggcagtaagaactggctcatttaaatactgttaaattatcaggacaagtattaaatatgtaatttttattaaatataccactggttgccagaagaattctcattgatgtagcagttttcacatttatatatatttataattttaaaatgatagataacatatactgaatgcttactattagccatgccctgtttttcataaattaatccatgtatataagtattttacatttactcatttatacagcatgatgagcgacaaggtgctatcattattatcattatcatcttagatggggaaactgaggcatgggggccccacagcactaagtggcagagccatgattcagcagtaaataatccagtaccaaagctctggtccttagcaattatacctgtactgtctctctatttgtaaagaaagtgtaggtctttaaatgctattttgaacagatttccatatacctatgtatagaataaccaactacaattgaacttttattgtaccttatcatactctacagctagatggctgtctttagtccattttgcactgctacaaagaaatacctgaagctgggcaatttataaggaaaagagttttattgggctcacagtgcccaggctgtacaagtagcatggagccagcatctgcttctggtgaggcctcaggctgcttccactcatggtgaaaggtggagggaagctggtgtgtggcaatcacgtggtgaggaagaacacaaagcagagggggaggtgccaggctctttttaacaaccggctcccatgggaatcatgtgtgagaactcactcactgccccccaccaaggagggcatcaatcttttcaccaggcatctgccctcatgacacaaacacctctcattaagccccacctccaacactggagatcaaattgcaacatgagatttggaggggccaaaacaaaccaaaagatagcaatgtctctggcatttaaacaatatatttaaactatatttggccacttaaaactacgtttgaggcctacctaatttaaaacgaatgaaaatagacaataattctacccttataatgcctaaaatctagttgcggagatttaaaaaaaattctaaccgttccataaataaacataactttgcaactttggcaaataatacaaaatagaattacacagaattgtgagagcttttaaaagatggtttattctcgacaggaaagtctggaggggcttccttgtgaacaggtgaatggatgaacagtcattaacctggtaaagcagggaccagtgatggggagctctgccttcggaaatggaagactgctgttacagaacaaatccgctatcaggaacatccagaaaaggtcaaaggcactgcagagctgccaaggaagtgaggacttgtgtcttcatgtccaaaagatggaagaacagagaggtagagaaatataggggtggcattcactcatttgcacaaggcagctgacaggttgtggatttctatagacttggggtctaaaagtagaagtcctgagaaacacactagagtttgaattggaatccccaaaggctacacactagaaaaaaagaattagagatggaattttcctcaggacgaaagcccagactgtaaagatgttaacccttgtctaaattaagaatatttgccttcttcctaactacctgccagaagcaaaagtgaatccactctggaggaagacaaagcatctagagcttcaaattatctgcacacctagtattggaaatatgaagtattgagccaaaaattaccaagaaagaacaaaataattgaacaaagagcaacagcaacacataagcgcgcgtgcgcacatgcacacacacacacacacacacacacacagacacacacaccagaataacagaagaaccagaaagaacttattagatatggactttagcatgtttgtaaaactaaatcataaaatacagagttattattatttatttatttttgagagggagtcttgctctgtggcccaggctggagtgcagtggtaggatctcagcttgctgcaacctccacctgccgggttcaagcgattctcctgtctcagcctcccaagtagctgggattgcaggtgtgtgccactgtgcccagctaatttttgtatttttagtaaagacagcatttcactgcgttggccaggcttgtctcaaactgctgacctcaagtgatccacccacctaggcctcccagagtgctgggattacaggtgtgagccactgtgtctggcccaaaatgtagaattataccatgaaatggaaaccatttaaaatcaaatgggcatattagaatggaaacaaaataagatatgaaattaagaactcaatgaatggatttaacaaccatttaacacagctgaacagaagaaaagggagcaaacaaaaaaattcaatatctggttacaagtagaaaaatgtagaaaacagtgtaacatgcataatagatgttggaaacctctagtataggtgtaattaaagttgcagaaggagaagacggagagaatagaaagggaactgttacagatgagatcatttcaaaagtaacggaaaaatccaacagatattagctgctgtatgaacttcagatagattacaacaaacagacaaaatgtacctaaggatatcataataaaatttctgaaaactgaagacaagaggaagtctaaaaagcagtcagagacaaaacatatgttatctttaaggggaaatagaaatactaataatgactgtataagagtgcaagtcagaagatggagacatgacattgtcaagtgcggaatgaaaataaatgccaaaatagaactccatatgctctaaagttcttcttcaaaacaaaggaaaaatataaggacatttttttgaaaaacaaaaacctaggaaatttgtcaaacttccagtaaaggaatgactgagagaactcttcatgcaaaaaaacataatcacagatgaaaatagatgacttaagaagagaagaatggaaaagataaatgtgtggctatgtccaagggaatattgattgtacaaaacaatgattagaaaaaaatacctatataaatcttgataaataatagcacaaaagacaggactttgttaaataatatttgattactcaaagttccttattacctggagaattgtagatatattaattaatgcaactatcaactaattgaaattaatatgattatcaatataagattctaattaagaatatattttgaatttatggggtaaacactgaaagaataataattgtttaataacaggctaatttgaagaagatttatcaataaacataattaactcaaaagaggaaaaacgggacaaacagaattagtaagattgattggaatgccaatgtgtcagtgattgcattaatgcaaatggattgaatactcagattaaaaggcaaaattgtcagactgaattagcaaataaagacaggcagctcacaaaaaaagctgcctaaaatatgaggaccaaaaaaaaaaaaaaaccctgaaaaaaagagagtaagttgaatacatgcaagcagtaggcaaaataaaattggcatatataattttgcaaatgacactgaaaggcaagaaatgacacatttctaaatataaatagtgtcattgcattaggattaaagggtctatctgacaagaatttataatcttagactggtatgcacctaataatatagcttcaaaatatataaagcaaaaattaacagaattaaggaggaaaatagacaaatctacaatcttagattttaccatacctctctgagaaactgaaagaacatccaagaaaaaaaatcaataaggatgtagtagatttgaaaatcacaatgagctaacttgatctagttgaaaaatacagaaatactacatctgtcatttcagaatatacatcatattctatccaatatgtatatgcattgcccaaattgaccgtatgtttgaaaacaaatcacacacacacacacacacacacagtatcaccaagtatagggattgaaattctgagtattttttctctaactatagtgagattaagctaaaagttaatattaaaaatatacctcaaacatctttaaatatttgtaaattatttctaaacaactcattggccaaaaataaaaattacaaaggaaattaaaagtgccaattttataacctaacatctcaataatttacccaatagaacagcaaataacacacagtcacacattgcttaatgacaggatactttatgaacccaacattcagtgatgttagtcattgtgtaaacatcaaagagtgtacttacatgaatatagagggtacagcctcctacacacttagcctatatggcatagctcctatactacaaacctgtacagcatgttgctggactgaatacctaattttactgtaccttttctatgtttagatatgccatggtaagtagttgtatatctaaacatagaaaaggtaaagtaaaattatggcataagaaataaataatgttacatctgtacagggaacttaccataaatggagcttctgtaacttagagttgctctgagtgagtctgggagtgagtggtgagtgaatgtgaaggtctaggacattactgtacactactgtagactttcccaacactttacacttaggctatactaaatttgtaaaaacaaaaactaaaactaaaacaaaaaaaacccttttcttttttcaataatatgttaacgttagcctactgtaacttttttactttctaacattttgagtttttaaaaaattatttgattcttttgcaatcacacttaccttaagacacaaataatacaatcatacagatattttctttatattcttatctatatgcttttatctattttcaaatttcttatttcatttgttactttttaaactttttgctaaaaattaagacacacacacaattttgtgtttattattatcaaacattatgtaccatacataattgtatcgctatacttttaaacaagcggtagtgcaataggtttgttcacaccagcatcaccaaaaactcgtgagaactgcattgtgctatggtgttaggacaatgatgatgtcactaggaacaggaatttttcggcttcattataatctgggactactgtggtatatgtggtctgtcatatgttgactgaaatgttatgtcatgcatgattgcataaagaaagtaggaaaaaatagtacgtatgaccaatcttattaattaaattgataaaaagtgcatgacacaactcaaaaagctaaaagttgtttttcaagcaaataattaaataggtaaacaccagggaagattgaatttttaaaaatcaagtattaccctattccaaatgaaaaagaacatcattttaatggaaaccaaaaagaagaagtatttgcaatgcttattaactgacaaaggactcatatcctggatatattaaaaggtttgacaaataaagatattaaaagtcctggacactacaaatgacaaatgggcaaaaacattaacacgcacgtcacaaaagaaaatatccaaattactaagaaacatataaaagctttccttttcactgtcattagtttttgaggcaatgcaagatacccgtataccgtcatcagaaatgttactcaaaagtgaaataaaacaaaatataacctgacaatatcaaatggtaagaagaatgtgaagcaacaggtcactcacatcctacttgtgtgggagtaattttgtgcagcctctgtttatcaggttacacaaggctgaatacacacattctaataaatctactaaggctaaacatataccttctaataaatctatcaagtttctagatatatagccttcagaaattcttacatgtgtaaatcaagactgtaatgagaatggtcataacatcattatttatgttagtgcctatccaagcaaaaaaaaaaaatccaaattgactcaacaatagcatggattgattatgaaatgttcataccatggaatgccatgcagtgatggaagctgactacagctacatacaatatctccgagtctcccaagggagacagagtgaaagaagccattcacattgattccatttatatggagttcagaagtctccccagctaactagcgttagaagtcaggatagtgattttctcaggggagaaatgggattgtaactagaagaatgcaccaagaaatcttttgagacaccgcttatcttgtatgtcttcatctggttgtgattacatggatgtatgcactttgagataagttattaagttgtagacttatgacttaggcacttctctctaaatgtcgtacttcaacaagatgttttggtttgtttttacattaaaagacagaaggaagaggagagtatttaaggtaaagaaaatagcacgaaaaaatctctgtgcaggaattaagtgtgtaccaagattgaataaagccatgtgaatggagtacagaggtaaagaaataaagataaagagaggaggaggggagatgggaaaaaaggaaggaggaaaggagaaagaaaagacaacagaaaaagaaaaaaaatgaagctggaaaagtaagtaatggcggcccctctccaaggtccagaaacttggatacttccctaatagcagtgaacgccagagaaggggtttagctgtggagagtgtggtgatgtgatgagatttgtacttcagatatctctagatgaatgcactggagaagggaaaaaagtagatgtgagtggatgaaaaaagaatgaacagcagttgtccagcagagagaagtgttcgttacctgggtctgagtgttggtggtagggaagctgcaggaatgtataattgtgtggatgctgggggtagagggagagggagctatgcttaaaataccagcccaagcttttctaactccaaaatatcttttatttatttgtttctttctttctttctttttttattttgagatggagtctcgctgtgccacccaggctggagtgcagcagtgccatctcagctcactgcaacctctgcctcctaggttcaagcaattctcctgtctcagcctcccgagtagctgggactgcaggtgcacgccaccacagctggctaatttttgtattttaagtagaggcagggtttcaccacattggtcaggctggtcttgaactcctgacctcaggtgaaccacctgcgtcggccctcaaagtgctgggattacaggcatgagtcactgtgcctggtccaaaatatctcttaaaaagtcatttaaccacgtgtttctcttttctataactcgttgtaaacaatgaattcctatatttaatagtgatgtcctttttgtattctagtttaataacactatttcatgggttaattgttttaataggaatttcctagtcgatatagttttatttattacctcattggaggaagagttttatacatattttatagaggtgggcccaaaagtccccgctatgttggtagacacataataattaaattttaaaaagctatggccttctaaatttttctttcttttgaaataaatatatacagatttttgacttatttatcaacaattgtgccatcttataggaaaattaacaaggttcatttatgaatgtgtcacaaaactgcttttcttgaactgctgatgtttgaatattataattttatgccatctgtgatatgagcatttgttacatataagttctatcataagcaaactaaaatcactccctttgtttaaatgtgtttagtaagtctattgctttcagtttataagtgtttgaccattgctcttctataaaagactctacaagaactctaaaatatatactgtgcttcactgattctgtaaaatagatatgtaaagtaatttcacattgttcaaagatactaggaatcacatacacttaactgcttatattttccaatactttgcttagttacaaagtttctgtataaagatattctcatgtataaaagagcccaacaattgttttgtacttcttacacttccttaagatagtatttaataccaacaaaatactgcttgagtcaggaggccttaatcaatttgttagagtaggaaactgaagagttaaaatagttgtggtattggcctacaccgacatgtgacgtgagacatggctgtggatatgacatccaggctccatcctctgttcctcctcttggaaattcggtctgtagcctaacacatttgttaatgcacagagacaagtatgtggggagaaaagacacactgagctggatacctgtgtattttggttcatacctgagatgaacctgaaatacagtctattacctgaaatagaagaccaacgtgttgtaatgaatttagtctgaattatctcattcctgggaggttcctgttaaattgagcaagtgcgagatagagatgaacataaatcatttctttcactcttagtctactctggcaaagtgaaacattgccaaagataacagtcttttaattaattttggaggttggtttatgtatacccttggaatttcttggatacatgcttcattaataggccaatatgcctaggtttaaagaagatatttattttaaaatttaatatgtcgattcttagttgaaagtatagtggaagaggcagcagcataaatatcctctcatttattgcttcgtttgttcgagaaacatgaattgaacaacctactactcatcagtcagtgtgaaagtaggaggactcaaagaagaacatgcaggcataggccttcaagttgggatgcaaaggcagccgtgccaataagtaaatatgtgtgataagttgttagatgtgcaattctagctataagatgattgatttaatggccaacatagcccttgtaatataacattagcactgaggtgagattaaattccgtttccatctcttggttgcaaagggtcagtggggaaatgggtcatctgtgagcagggttgatattggacttaatagttttgcatggatgatctataaatggctcttctctaatccttactacctacccaaatgatatccttattattccaacccaaaattagtgcaggagcttcctagctgccttgcctgtccctgtctccctgctttggagggtggatttgattttaaagtatggatcatgctatatcaatgtctacctgggggccttggctgcgacattcctgtttttgtaggacacggctcacatggctctcactgctggtctccacatgtccttccaccctcatttccatcacccagctctgcttccaggtgatagtgtactgaactactcaggccatccctctgcaggcattcattttccctggctccaggtcctaatggctaaatttgtattgctcctataaaatgtatttcagctgtcatcacttgctttagctttctttcatatttgcctaaagaccccaggagccctgccatctgtattcctgtatcatatttgtacaattatttttgttgttgtccatattgttaatttgcatatcacccaccagacaccgtgagatcctcaaggacagggactgttttctataataaaatctatcacatgtcatcaagcttggcatatcattagtctctcaacatattttaagttaatttgtctaatttctgaatgattgagagaagctaaaaacattggttatatgctttctccaaacgattattatcatacctgtgtgatttgtaaaataaatgccgacccatctcatactttttctagtagatatcttcctgaaaatttatgggtaaattaaatcatgtgaaatgaataatgtcttcagtgaaataggacagctcacattttaaagaacatcagtaatgaactaatctgtgtaaaagaatagttttagtctcttttcttatgtcacgttgactgtcgcttttacaaattgggaattttacaggttgagttgccttatgttggggttcctctaggtaaaggtattcatgcagttaaacttctagtaataagcaacaagaaaataacactgataaagtgacatgaggaatctgctcctgtgctgtaactatttcctgatgtcaaatgtgaaactgaacattttgccaaaagtctcaacttaaatcaaagccactttaatcaaagcagttgctaatgccagcagtacataaattgaggatggagcaaaaggatcgacaccaccaatggctgcattgtgataggtgtggacagagcctgccagaattaaacacatgccaggagtcaacactaggcaaaggtaaatgggataggtgctgtgaaacatggcagatcctatgggacttaggtgctcccaaacatggcagaccctatggggcttaggtgctgaaaaacacggcagattctatggggcttaggtgctgtgaaacatggcagcttctatgggatttaggtgctgtgaaacacggaagattccatggggcttaggtgctatggaacagggcagattctatgtgaccaaacctaacagaaacagtgcggtgagaatcgtaagataaacatgctattcctgtgatctgggtgaacaaacaaacaaaaacaggaaatacaactgcaaaacctagacagagaagagccaaaactgttgataaatataggaccaccttcgcatccccgtttgcgaaaatgttgataaatataggaccaccttcgcatccctgtttgtgaaactgttgataaatataggaccaccttcacatccctgtttgtgaatgcaatagcacaagaaaaagtcattttgaggatgggatagggaatgaacttctgatggtaatgctgtcttcaaatggttccgaattgaattttatcagaaatttaaatacccaaaattaatatagaaattgagaaccatcttatgttaagcactttttccttacacttactttccttcttttccttttttttgttctttttttttgagacagagtttcgctcttgttgcccaggccggagtgcaatggcacaatctcggctcaccacaacctccgcctcccgggttcaagcaattctgcctcagcctcctgagtagcttggattacaggtgtccaccaccatgcccagctaatttttgtaattttagtagagacgggattttaccatgttggccaggctggtcttgaactcctgacctcaggtggtccacccgcctcggcctcccaaagtgctgggattataggcgtgagccaccgcacctggacctgtctttcttacagagacctcttagcctcattcttttcctctccagtattccatatggcagtggctcaaggtagacacgttgcaaagaatgaacaggcattacctggatattcaggattgctttgctgttttattctgtgcagtgtttccttttatgcctgcttttcagccctatcctttctgcagggctctgggtcacaagctgggcaggaggagcagaacacagcgcctctaacaagtagcaggactggacgctgttggttaagtgttaggagaaaatgtgtctgctaatagggttatttgtttctttttttgggggaatttttattttttattttttatatataaactttaagttctagggtacatgtgcacaacgtgcaggtttgttacatatgtacacatgtgccatgttggtgtactgcacccattaactcgtcatttacattaggtatatctcctaatgctatccctccccaattcccgcaccccacaacaggccccagtgtgtgatgttccccttcctgtgaccaagtgttctcattgttcagttcccacctatgagtgaaaacatgcgttgtttggttttttgtcctcgcaatagtttgctgagaatgatggtttccagcttcatccatgtccctacaaaggacatgaactcatcgttttttatggctgcatagtattccatggtgtatatgtgccacattttcttaatccagtctatcatgttggacatttgggttgtgggactgtaaactagttcaaccattgtggaagacagtatggcgattcctcagggatctagaactagaaataccatttgacccagccatcccattactgggtatatacccaaaggaatataaatcatgctgctataaagacacatgcacacatatgtttattgtggttgtttcttaacataaaggtttaatccgtatgattccacttctgatttccagggataatttgaaggaaactataaaaatagaaggttaaaaaatatgtttgtcggccgggcgcagtggctcacgcctgtaattccagcactttggggaggccgaggtgggcaggtcctctgaggtcaggagtttgggaccagcatgaccaatatggtgaaaccccgtctctattaaaaatacaaaaattagctgggcgtggtggtgggcacctgtagtcccagctacttgggaggctgaggcaggagaatcacttgaacctgggaggcggaggttgcagtgagccgagatcacgccactggactccagcctagtgacaaagcaagactccgtctcaaaacaaaaatatatatatatatatatatatatatatatatatgtttgtcttcttgatttttcctctcctccatcatgtggtgatgggatgggaaaaggcaggttgtggggagcagtttggaggcccatgcttggtgggaaagagagggaggaaaattctagatgaacgaatgccgcttcaaaggaagaagcaaaagaaccatattaaccctgcttacaatcggatttagattggtgatatattctgtccacactcaactgggtttatcctgacattcaacagtgtaagtgacctgtactctaagtgttcccttcttgagaaaaggtgtgattgagcagcctgctgttgtctgaatttttgtctctcccttttccagaattcatatgtgaaacctaaccccagggtgatggtgttaggggctgaggactttgggaggtgatgaggtgatgagggaggagccatcaccctgataaaagggaccccagagaggtgcctttcctcacaccatgtgatgcacactgagaaggcgccatctgtgaaccagaaatcagattctcaccacacaaagcatctgcttgcaccttggtcttggacttccagcctccagaactgtgagaaataaattcctgttgtttataacccacgcattttacactattttgttatcacagccagaagacagtaagacaaatcccaacagagaagagtgcttctagaacctaaagtgcacctaccactttctagcaaagcctgatccacattactttaaaagtgacttttcaagcattttgctttggtttacctatttcttccacttacctctctcaagcccaaatcattagtttacacttgtaaccaattgctcgtgcacatgtcctaatgtttttgaatatacatatattaatacataatgtatcattcgtgtttgcatgtgggcattgtggataacttacatgtaattacagttgcaattacttagaatcatctacttcttcatgagctcgaaagtgacctcttattcttttttacaaacggagatttttttgtgaatgtaaataatggaaaagcttcccaaacccctcccagactccagctcccgccatgcccttcccctcaggcgctggcacgcccttacacacacacacacacacacacacacacacacacacacacagcctgatgtgtctatcagctctgaatctggtttttcaagtggcttgggtgggtctgcatatgaatttgaccaacctctgcgcgcgctcctgggagcgcgcatctgtgtgtggtccagggagccaaccgcgtttgtgaatggatgattgatgggaacagcgcccaggggcagcaggtggagacgggaacccaggtcgcggtcactggtcaacccgcctcttggggtggaggttagagaaatgggcgctgggatttggccccggccagtgctggggttccagggtagggagagccgtgggcgccagactgggctgcgggaggtcttcggggtcagatcccgcaggcagccaagagcgagccaaagaaacaaagccgccgagggacgcggctggggcggaggcccggagggaagtggaggccgggaagccaggtgtgcggcggggagagcggcccctgccacccgcgctggtagccgggcgctgccattcactgcaaggtcctctgcgccctggaattgccgcggcggcggatgcagaggccaacccagagtgcaaccatggagacgcgacgtgtgtcccatagtaacctgttacaacattatttataagctgccatccctagccttcccccgcttcccctccgctccctcgccagacttgcgggcgacgggcacagccgcgtctggctcttcccggcctctcccttctctcgcgggcgcagccgatcaatagttaacacccggctgcggacggcggctccatccgcggcaatcaccgtagtgcttgtttgtggaagccgagcgtgcgtgcgccgcgcgcgcacccagtccagcgcggagtgggcgtctacccgaggaggggtgtctggggaggggctgccctcgttacccaaacagtttgcgctcgcttaaccttgatgcagctcgaggcttcccagtccagctcagttcagacagaaaacctggcgcgcgcgcgcgcacacacacacgcctcccctggcgtcgccgcccggccgggtccctgcccttagggaccagagcggcgaccgctgcaccccgcaccgcctgctggaggagcccccggagccggggccgagccgccggcgtccccgagtgcgccccctgtgcgtgccgccgcgctgttgctcgcagtgtgctggcgccgagctcggtggacacgcgcgcagtcagagctgcctctcgccctcgctagctgggctcgcagcctcttcctccctccctggctcctggctttttgtttaaagcaacacccaccctccatccaggctttttttctttctttctttattggtagcggccaaaaagagttgattgctattgggatccgctgagtaaagacacgggcaggggtgcgcggaggtgagaaaactgaagacctggaagatttttttttccttcaaaaacccgtttccatccagtcttcagccagtccagtctactttaatcctcaccaggacaatggattaagtttctcttccctggaccagaagtcgggttcggacttggggcaaaatgaaggaaaaggccatgatcaagaccgctaagatgcaggggaacgtgatggtgagtgccacggacagggcgcgcgctgggtcggggggacccaccgtgaggagcgatgctgggggaggtctgtccttctcagtcccgaacctccctggaaggacagcgaccccatgcccgcgcgcggcggcgcttctcccacttcccacccgagcccacccagcggcagggggatgcggaggagcaggcatttctttgcaaattgcaactttgcggctccgcggcccctctccttcgggcatgtggctttgtgttttgggcgcgggatgggaggaaggggctgcggggagccctcgctgaccgcgggtcggtccgagccccaagcagacccccagggctcttctggggaaacgcggggagaggtggtcacttcggccagggaagggccactgggccctggcgcccgcgccggcctcggtgctccgagtccccggaactcgagacctgttgggtctgcggagccttcggtgctctcggggcaggcgccagtcgctccgctccgttccagacgccgccgccgggcgggaccctgctccctggattggggacgctgactcccccaaaagcttgactgtgccggaggaggtcaggggcacttcgtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggctcacgttagtccggggcacggggccgaggggtcagggcgctggagtctctggcgaggacgagagagttgccatcttgttctgttgaaattgtttgtgtgccttcgtgtgtttattttaacccattaggtcatggtctgagaagaatcctctgacggtcccttattttaagttgctggctggcactttttttttttttttttttttttttggcgacagacaaggagatggggattgccttgctacttttgaaggttctgcagatttgcagatgctacttttgagggttccgtaagaattgaagaaattctttcaggggcaaggtccagagttgtttacagaagtgggttgggtccaagtgatgggggtgcagaggcacctttgcgggaacccaggcagtggtgcattttgagatctcgctttaagcaaaacaggcaataagtgaaaaattctacattaattgaacaaatacccagctggcttaaccacacccacggcagacacctgttgcctggcagagagaagcgccgtgggttcagaacttgactctggacggaggtgtgagtctctgggttcaagacacctcgcagggaagtaatcgccgcatggaggggcttactcttcaggaccctccccactcccgagacgacaagcccccatctaggggcggttcgcagtcctcggtccgtgggttctctgactgacctaattgcttgtttatgaaaatgcatctgcttccctcatttttcccactctttttcttttttagccattgtgttgttcagcataatttcttgcataaacaggatagaaacgtgtatggagtaatgctttttcattaaatgcccaaccacatccatcattcctaacttacgtgatgccatcatgtgctagggaaacctgtatatttagggctgaggctgaagttaaggattgaggttaattatactgataaggcaacattattgactcattacatcaatctaccgccaaataagtttctacttataacttgcatggcatgaaagagccaaatcttcatattacacctttattagaaaccttatggtctttgccctccccctaacccctctctgcgttttacttcagaaaataaagaatgaaaggattgctaattacatttctctcttctgctctgaataaggatattccatgtgatactcattgcatcccttcccctgtgtctaatgttaagaagtgtcatcggagcaaggtgaacctgagcctagagaattctacagcaacccatattttcagagttatttgtgggcccaagaaaacaatgagatgcacacttactcaaactttgaatgttcttatcaattcttgaattgataattatggctccacagcctgctgtgtaacttatttgaattttcatgttccaaggaaatccacgtggcttcagttgagtgatcatttaggacttacccatgcctaatctctcaagttgctttggaagactcttgctaatcacagcctctcttggattagatgactggcaaattctttgcactcacaacttgattgaaattcaggtgatattttacattcaagatgaggactgaatgatttactcctattactgacagctgagctgccgcacatctgacagctacaaaaagtggcagaatgttttctactttgcagtaacagtgaacccacatacacacagagaccagatctcagttcaggggactcaaagatctctgagctgtctggactcgcatttgaggtttgatatttaaaaaagagaaagacactttgcactgcccaaatggtcacggaaatgtcaaatccagttcagccatgcctgtaaactgctttctaatccagcccctgctcgctgacatccacattgtatgattgttctggacctgcagcctgttgtttcaccgggagttctacaagaatggtgacaatagcctcccggctggtccttgccatgccacattgcttagttgaaagtatgttcttataaaatctttaaaaaatgttttattcctcacatattgctttaggaatttatttctgagtacagctagaggattaagagaaggcagatgcaccagcatactatctgatcttgttttgttttagtaaatgggtaaaagaaataccacaggtggaatcagtttagaacttttttttttttttttttttttttttggagacagagtctcactctgtcacccaggctggagtgcagtgcagtagcgcaatctcagttcactcctcccccagggttcaagccattctcctgcctcagcctctcgagtagctggggactacaggcgtgcaccaccatgcctggcttttttttttttttgcatttttagtagagacggggtttcatcatgttggccaggctggtcttgaacccctgacctcaggtaatctgcctgtctcggcctcccaaagtgctgggattacaggtgtgagccaccatgactggccagtttagaacttctattttaatttttttttttttttttttttgagatggagtctcactctgtcacccaggctggagtgcagtggtgctatctcggctcactgcaagctccgcctcccgggttcatgccattctcctgcctcagcctccccagtagctaggactacaggcgcccaccaccatgcccggctaatttttttgtatttttcgtagagacggggtttcgccatgttagccaggatggtctcgatctcttgacctcatgatccacccgcctcggcctcccaaagtgctgggattacaggcgtgagccaccttgcctggcccctagaacttctattttaattcttgagaagagtctatttcataaacttataatactgtgagaattcacagactaaccatgccatattcaatctgtaatttaatatactaagagataaatattttttacttgctcgaaacaaaaattatttttttaaaaatagctgttattttttccataaaatctacatttcagagttccaagggaggctgatgtgcactttttcaacctaatcttcctttattgctgtttggttgatattctgcttgtttaacagaggtatatactcttgcaataggttctgaggttaatgggaaatgtcatcagaagggtgttgcttcgtgctgaattcccctactctgtccatatgagcttttttcagacattgagttgcttaatgaagttggagtaaagattaaagactaaacatcttggggactgtcctgtgacccttggcgtctcccccttccttggtgtgtgcattggtggctccaccagtatgtggtgggtaagtgagggctgtgcaggcccatggtgactacagcagtatcagaggaggttcagacctaggacacaaagcatcagaggtctgcaagccatgttgatccttgagaatcccactgttgattgttgttggttttaaatgaaagtggctgtcttgagttccctgtatagggaaagctggagttcttccttgtgctcactgacactggttttaggcctttggtcactggttgatgtatctatggcatgacgagcctaggatcttttcagaactattgtcttctcttttctatgttggataaaacatctgaatgtgaactttccacagtaagagttctctttcgggcatttgaccgttttgctgattcagttaaataaagcagaatggcattccagcgatgatgctgtacttgtaattagcccaggtgagcagaggctcgttgaggtttttagataagtcatgagagctcgtgtgggacacaaagcttctattatttttttttttctgagatggagtctcactctgtctcccaggctggaatgcagtggcacagtctcagctcactgcagccttcacctcccaggttcaagcaatcctcttacctcagcctcccaagtagctaggattacaggcatgtgccaccacacccagttaatttttgtatttttagtagagacgaggttttgccacgttggtcaggctggtctcaaactcctgacgtcaggtggtctgcccgtctcggccccccaaagtgctgtgagccacctctccctgccaaatcttctattattgaagtctgtggggacagcatttctaggagtgtggccttcagtaatgcaatatttttcctctgtctgagggtacttggtatcagattggtcacttggtaacaaaatgcttggtgctggttctaaatgggagcagtgtagcacagattttgagggaatttgccttctcaaaatgggttccaaaaattctaaggtcacagttttctgagagttgtcaccatgtgtcccagtggtgtgatacttaggttggtctttctctgcttgctagttgttcaacatcccttcataaaatcatcacccttataactagacgtttcttgaaatattgattaatcccatctgtgcaggaaacagtagctaggcatgggtctgtttcataatcctccttgcaggatttataggaatggggatactttaaacatgtttatggcccattaaaaaatgcagatttccagaaagaagatcccaaagccagaggtgatcagcacaggatgttttataaaatttcttcaataaaactgtagtgaagagggctgtgctgttttttcacagagctctgtttagttctttagttcatatatccactgggtctgagtttttcaacatataaatgtactaaattggctcttccctgttgcacagccatcatctccttttctgtaacctgtcctggtcagtaatcacaatactgctaacttgatcatcatttggactttgaaccctctgtgctattaccaagaggtgtggtgcttattgaaatatgaacatctagtattcattcgtccccatggacaagggctttgcacaggaagcatttgagcggatgaattcgttaaatgaatggatatttgttccttgcttaggactgcttagcataggctgtgcatttgtgagaaaggctcatggttttagttgaacgtttaagaactccttcaagtcctaatacatcaggtaacaggagagagaattccctgcatagagtattttccactttcagctacaaatggaaacttaggctcagtttagattgtaaacagctgatgcatcaatcttctttatttgaggaggcgtagaagtcaaataaaatatagagagcaatctctcaacttaaaatgttttacttgggaagcaagaattgcaatctgaggcatacacagaccagtggtcttcagtatgtctgaagaacaaagacgagattgtggattttattaggaaaggaaatgttacttactgttttggaagaaaactcattggccctggagaagcttttgagagctggcaagctctgattggtgagttgactgtggtaggtaaagctagagtcactgcaggttgtttcagcagttactaggtaaaactggtcttagaggtacagcaggctgtttcagcagctgagcttgtgggaaatttaattcttggagcaggtgctatgtgtccccagtactttttccctggccccgcaactcacacattgagttgcttaatgaaaatggagtaaagactacagactaaacttcttggggactgccctgtgacccttggtttccaaggaccacaaggattttattgggtatgacaagaatgacccaatttgtataatcagcttttgcagaggtaaatacatttagtccagatcattttaaaattttctgtttattaaactaaaataaattcagcaacatagaagaattccatgacctcttttggttgtgggagccaattttatttgatagcaagaccacattttagaactcaagagcgtgcctcagatcttctaggtcccttgaacatactaagctcagaacagacaggcaggcagaaccaagcagaattccccctttaccattgtggcttcctgggatgatgggagaaagggttccattcgggaagtagaagtttcaaaaacccatcttggacagtggctcttggcaatggctgaacagtagaatcagctggaatgttttgaaaaacccagtcatctatgggtgttgtggagttgggaatgtttggttaagtgtagaggttctcaacattgcctggagccactggttcctcctgcccccgacctcttccccagtacccacccctggcctagagatacccaggggattctgattccactgcttcaaaatgcagtctgtgcactcatatgtttaatagtgcttctgttgtgcagccaagatgcagaaccagtggatcagaggcaaattttttgaataaatattgccatcaaagcctaaggaaataattataacatttataagggagcttcttgaaaaatatgcaatcaagtcttgttccctgggttgtggaggccgccaaatacatggaaagatgggcagagaacacagaataaggagaaaaatgaagtgaaacatgcatgagagagaaaagtaaatagtcaccagggaaaagatgaggaaacatgctgtgtttttaagttttctaacctcagttatagactgaatttggggaaaaacaagaatctttaaagaaattcaattgtcctcctttcctttttcttcacgcccagaaaaaattaatcttcttgactgaaagatactctattatgtgtctgaggtccccccgaaaagttattacaaacccaacagggcaagtagaaacaaggagggtgatagaagaaagctgaaggctgccctcgaccagcagaagttgttctgggatttgcaatggcctctgaggggcctctgcaggcagctccctggactgctgtttcctcatgtgtcgaataaggaaatttgaatagattgattattcttgaagtccctttcaactccctctcccagttaagggtagcctcattactgtctcctcaacattgctcttaggacatgctttagaagtcaccttccatgccagaacaaatattttgttggcatcatgatttcttctgcattgacttatgtggcatctctcagctcgccagtcttgtctcagcaagcatgccactgtatacggggaaaacaaatagatggcatcaatgtatagtcctattggacacaaaatctagagcattcatgcaccagccttgatgacccaggaagactgtatatgtgtgtgtgtagcacaccatatacatgcatgtgcatgcgtgcacacacacacacacacacacacacacacacacacaatgttcatacatctcagatgtaaaatactggcaccattgtccagcatagctgaagatctgttggataagagctcctgtgggtgcaatcactttgactgcttggctttcttggatattaaaaaaataaccacactgtaataaaacaggagtgccaaggatgttctggtttccagtgtggtgttactcgtctgtgaaaataaaagtgaattgctggctagccaggccggccacaaggcctgttttgcaaggcaccaattggatgggatgggactgcactgggtctcactacgagaggtctaaggctgagcacattttcttcactgatattggtatttgaaaagtgggattttcttctctttttccctctcctactggactaatgcccctattaagccacacatagttttattttaaataattctcattttatggtattggtcctatataaacaacttttagtaaaacctccactgacagaaactcaactacaaacttgagcaaactggactaacagtctcatacgtttcattacattaatctaaaaaatggtacttctagggtatgttctgacttcattatacattcagcttaatattctataccttcttgtcctatatttttgggaagtgagaattaataattttcaagcctaaaggccaaatttttttttcattcttataaaaattattttgattgtggactacattttctatgatgaggtaaaaatgaattaacacatgaacaatttatctttaacaggctgggcacagtggctcacacctgtaatctcagcactttgggaggctgaggtgggaggatcacttgaggccaggaatttgataccagcctgtgcaacatagacagcatctctacaaaaaaatttttaaaaataattatccagaagttgatattatattatgtggctgtcatcctagctactgaggaggctgaggcaggaggatcttttgagcccatgagattgaggctgccgtgggccaagattgtgccaatgcacttcagcctgggtggcaaagcaagaccccgtttctttaaaaagtaatacataaataaatatacttatttataacagaaaatcaaagattatcttgttaaatggtagttttctagaaaattgcatttatcagaccaaatcatatcttgagcaaactttttataagagggttctgttttgttatttttcttcctatgactctgtaaattgtgcatctatttttttaagatctccaccctttcatttcaaacttaattatattgataacttatagttgtagagaacttacacagcttccaaaataattttgtctgtgctatgttattatgttagaacaacccattgtgttggaaagacagatattagttctttttttatggttgaaagagctaagattttgagagagtatatagtggggctggttatttgaggaggagctgaggtgctgacccatttccagcccaggttctttgcacaccacaatgtattctttcagaaattatcttctttccagttgcaactgaaaagaaacatagtgcctggaagatgggggagaaaaataagagatcaagtgggagagtatgtcttctgctctatcctcataggatttctagcctctgctggaacacatccaaggactggaaacttgtgccattgttgacaagttctgtttgttaaaatggtatttcttaagttcggaagatacatatacatacctccattgaactttcacctacagttttagcttgaagccttttaactacaaaaattttcttatccctacttcacatgacaacctttcaagtaagttccaacagttgccatgtgaccccttcatagtctcttttctagggaaaatgtctctatttctttcaacttatatatgaaagtttgatcagggtaactgtgaatttaacaacaagacaccatattttttattcaatcattgccatcgttatctgtttcttagcttccacaaatttcttcctatttattgttgttgatttgatagtcttcatactgttttccacagtggctgtactaatttaattcccaccagcagtgcacaagtgttcccctttctccacatcctcaccaataaatgctacttgtttttgagccattagtgaactgatagaaaacagcattctggaccgaaaaagtagattgtctccaaaagctgtgtggataaggagcaatgaaagaaagataataccaaggcaaatacctggaggatgtgaagccaagagcatcagaggagaaaaggaaccatcaagaggttggttagtgggtacaaacagacagatagaaggaataagttctcatgttcaatagcacagtagggtgactgcaattactaataatttattgtatatttcaaaacagctaaaagagtctgggtgcagtggctcacacctgtaatctcagcactttgggaggtcgaggtgggagaattacttgagtctaggagtttaagaccagcctgggccacacaacaagacgccatctctaaaaaaaatttaaaatatgccaggcttggtggcatccacctgtagtcccagctacttgggaggcttaggtgcaaggattgcttgaggccaggagttcaaggttaaagtgagctgtgatggtgccacggcactccagcctgggtgacagagtgagaccttgtctgtaaaaaaataataataattagaagagaagatttgaaatgttcccaacgtgaaaaaatgatcactgtttgaggtgatgaatatcctaagtaaacatacatcaaaatatcacatgtacctcataaatatgtataattattatgtatcaacaagaaaatgaaaacgagaatgttgaaacaggtggaaagatattcatatagagcctttgggaaatgctagtcactggacatgggaggaaaatggccgtcttcagttgcggtatcagaggccttccacaataagcagtgttaattggcaaacaggggctatgagaaacacacaagtgatgaaaaccagccttatttctactggaatctcaggtcttacctgacttaccaccatctaagtttgcatagtcacctctaaaagtgtgagcatcttttctgtgctttgctggtttgtatataacttttattcagatatctttcactctaataagtagttctttgcattctgattagttggctttatgaaataagtcaccattattcaagaagggaaaggcgagagacaaaggcattcggcttccattagtgtttggaattacagccacacacaaattaagggtgaatgaaaacaaatgccctcctgtagctgctgctggtattcctccccacctcctcttcactctctctcctcctcctcctttttctccttctcttatttatcctcctcctcttcttccttctcctcttcctcttccttctcctcctcctcctcctccttctcctcctcctcctttgattatcttaagccagatgtgtattcttacccaggtttgtgatatgtctacccttgcctttatgttgggaaacgtgaggaagctgagcccagctcccaggacagtttggtcgcctctaatcataccatccagccataatctcaggctgaaggaaatcattcattggcactaaagagagctggggagatagctgacagaggaatgcaatggatcgtctcgctcatccaccttttgccatttgtttgattttttcctgcaatgtgttttcttctcgtcaacttggccggaatggtggtaaatgctgtttttatatgtggacttacttgaaaaactgatctatcttagtcttggactttgaatatcattaaagttctccaaggaccttgcaaatagctgcttgccaaacacaatagtttaatataatttgatctctcactgctgcttagcttctgagaaatgtgttgtgctcaaagtgttcaagcattaattaaaattgagagcactgaaattgtcagcgcccactgactccatgtgagtgtgtaggtgagtgtgaatgtgtgtgcacaggcaggtgcaggtgtgtactcacatgcgtattaacgcttaggaagctgaactttgcttctttctcattaagagttgaaggctattatctaatcatgaaaataaaaactctgatggaattaacttgatgttgactctcagtttgatttctgaagataaaccagagtcatctctactctgaaatattaacgtattctagagagtggttcccaacatgatgtgacgctggacctgcgttatcagcatcagctgggagctttagaagaacaaaatcttgagcccacccagacctactgaatcagaagctcagagggtgggtgattctgatctgcattaaaatttagttctaagtgtacccattcgcaaactctttgtggtgaagtgccagtgatttcatttttgtttttaaaatttcgtggctcagtactttctcccatctttctgttttttttttttttctgagccctacaaactttttcaacctctgccctaaagctgctttcagattttcaggtatctttgtagcaatgccccattccttggtatgtgttgctataaaggcatacctgaggctgggtaatctttaaggaaaagaggtttattttgctcacggttctgcaagctgtacaagaagcacaggcaccagcatctgcttctggtgaagtcctcaagctgtttccactcatggcagaaggtggaggggagccagtgtgtagaaatcacatggccatagagggaacaagagagagaggaaggaggtgccaagctctttttaacaatcagttacccagggaatgagtaacgggatgactaactcattatctcgagggtaacaccaagccattcatgaggcgtctgcctccatgacccaaatacctctcagtagattccacctccacctccaaccttggggatcaaatttgaacatgaggtttggggggtggataaacatccaaactatagcagcacccaaaagctgaaagtgccatgtcttattttttattttcagccttatccgtagcacgctttatggtagcaaagaggtctacaagctgtggccccaaaataatttaactttcttactgtaacctttccattttaaatttgattcactgtagagcatttccatgggtagaactgggtcaaagagaagtctttcattttagagttttgttattaaggaagaattgggtattttcatactttttaaagtttatttttggctatgattacttacagtggttcattttttatagacatctaggaaatgttaattactgcagataagattcccaattcagaagccaaccacaaaggcttttcttcttcttcttctatatatatataaaggagataatgctaaaatgctcttatgcaaattttaaaattccctagtacattaacaatgctaatgacagttaatgcattcctgaagcttctgtgtgatccaaaatattcaaaatgcttagaaatgttttaggtccaccctgcaaatatatgggaagtggaattttgttcatggaaattagttccttgaaaatagattcagtgccaagtttaagagatgaagaagagctgaaaagtcagtgtagtgcaatatagagtcttctgcggataaaggtcgaaaccctcttttcccagaccaccatagtgggtaggtacagaatctcagataatcactgcagtttggttagaagaggaaattgcccttcataaagcaacacagaagaaggtaaggagaaagtggtattagattgataggtcaactaatgataatgaagaaactttctcttgctgacggtgatgtcagcttctaccaggactaacttcagtgagcacaggaatggcattgctgttcaatagggttataccctcaggtgggatgacagaagacagaccctcgttgtttctttgctgacctagggaattctgcaaagcagaaatatgaagaatgaagatgctgactctttacagacagctttatttaggtgaattcaggttgttacatggtcttgccacaagtgcatcttattctagaagttgtctgactacttcaacatgcatttctttccttctttcttccttgagctccttaatattaaatgcaaatgaggggaggcgtgttgaagttacactaaggtttagttgtagcaaaaatgtgctttgtgcacctactggaaattcccttgtggaatctttatagtaaagcctattggggaaatataattgaaaacaaaatcttcttccaacctagaaatcctctccacaaaggtagtagagaaagagaacacttttcttatttgaataagcattaaaccagaatggtgatgcacatcacagacaagatgctaaaagatcacaaagacagaattctcttatatagccaggcagatgcaacccattaaatacatgttttcaagataaacagtagctcaccctgaagtaagaggatttgacagcatcatttgtcaaatagttcatcctaactttactagctgcttactggctttatttagaggggggaaaagcctctcatatcttcatgatagaaggtagttttgcatattagagcaaagtgtccaccgatgttaggctccagaaactgggagacaggggttctgtctcccttgatgtttgcattttaaaaagatggttccagatctttgggaacaagatccccgggtcataaagctaacaaaagccctccctatctagtcttcacaaggatgcacttccaagagatgaaaaagtgcttataggccgggcgtggtggctcacacctgtaatcccagcactttgggaggctgaggcgggtggatcacctgaggtcaggagttcgagaccagcctggccaacatggtgaaaccctgtctctactaaaaatacaaaaaattagctgggtgtggtggcaggtgcctgtaatcccagctgtttgggaggttgaggcaggagtatcgcttgaacctgggaaggggaggttgcagtgagccgagcttacaccattgcactccagcctgggtaacaagagtgaaaccccgtcaaaaaaaaaagtgcttataattacaagttttcttaggtaaagctctaagaaaaaggagaagaaaacactttcctcctgattttcaacaggaagaagtaagtgtcttatttctagcttgtattagtccttacaagccagagcattcaaatgagtaaccgctacaatagccagcaaagctacagacacccagtaagaggaactggagcctgtcccaggcttgcagatgctgagtgctcgagatgttgacacaatttagccaaaattgaggatcaggagactgccaaggacaccggtgcttgatggaactattccctcttccaagaatttaagagcaagaaaaaaactcagccatatacttggagcagtggctttcatattcaggactaggagcatttgggttctgcaggatgtgggatggaggcatggctaaggagcagccataggggtgatcggagtggccacaggggtgatcaggcctgaaaagcctgccactcagaagcctttcttccaagagttgtttattcactgcttagcaatgagatcagcactttgcctgctgcatctcacaaagccctctgacaaccctggatgaaggtactaatatctttagttttcaaatgaggctcaaagaagttcaatgagaaaactgcccagggtcacctaggtagtaggtagaaaattagtatcccacttagatgtgtgtcactgtgtcatctgaagagaagagattaagcattgggcttgctagacaacaaggatactcttcaacatataaacaatcttattcaataaaatcttattaatgccctgttgactgaggttgcattaagagcatgtggaagcttatccgatgtttccattctctggtctctacttgtgactttgctttttattttctcttctgtgctggaagtgctggaaagcacctcatcttttgtcttttcagttgttggatttaggttccatgattaagggttgtgttgctattgttttcagtactttgttctctttctgtatcccaggaagtcagcaactgggccctgtctcctacagaagcaggaagaggactgagggttgagggacttttggtggttttctaaaactgtcaatcatcctatgtgtgacaagcagagagtttcctgtatctctgttgcctaagcaaaggagcaggtgggaaagtattttgctaactagcgatctaagatgaggtttttgttgttgttgttgtcatttttgagatggactctcactgtgttgcctaagctggacggcagtggcatgatcttgactcactgcagcttccacctcccaagctcaagcaattctcctgcctcagcctcccaagtagctgggactacaggcacgcaccactatgcctggctaatttttgtattcttagtaaagacggggtttcactgtgttggccaggctggtctcgaactcctgagctcaagtgatatgcccgcctcagcctcccaaaatgctgggattacaggcgtgagtcaccacacctggccagttattctttgattctcctgcaccatctttcaattttttacacttggggcattttccctgttctcagcaccctcatcagtgtggaccaggacaacgggagagggtaaacctgaattcctccaactctaatgactttattaaaaggcttgagggggagggcagaaagggtatagtggtaacagtgagcactttgaatctcacttaccctaatcatttcttgaatgattgaaggagtaatgggaccctccttattccttactcctaaattctcactattgattgaacgtctcatacgcaggcactgagacacctcagtgaataaaatatagtcctcgccttccttcttggggcttccattctagtggcagaaatagacagtgattacacagctaattatttaattacaagtctgatgcattctgcaaaaacattgtaagggccaagggaaagcttctcctttgccttctgaaggttcactgaaaatcaactgatgaaagacaggtgaacaggagaagaggcttacaaatttgatcacagttttacacaggagctttcggaatgaagacgcaaagatagacaggaagctgtccatttttatgcttaggttcaacaaactgtggacagctgtgtggaaataggattggcacaaagggtctgatctaatgccaatacagtgagggggaaagcccagtaagatctgcccatctagattcttcttggcctctctgcagaattccttccttctgggcatggggcagcaccctctctgtaatgggaggtcttatgacccacagtcgaacaaggcaggtcaggtgatttcgttatggtcagtttttacacagaaaggtggggaaagttggagtagtagttttaggttttatggctggcttttgggaacagaggatctggttcgtatgattatgttgggagagaggatcctagtttctctggccagcctcgggagaaaatgaggggccagaaacagaagagcaggagggggagtggggagaaatgtttgcttctgaggccttcattttgggttatcattttctgggcctcagcaaaagcagattgagattattattatattaacataagcattgtggtctaggtttggatgtttctacaaggtgtttcgaagcgaatgactcagtgaaagatacaatgggtgagaaagatggttctctcacattgtcaatccaaggcagaataaaaaagtcataattaaaaatatttcttaaaggggataaaatgagtatgtattggcaatttgctactacagtgaggtgtttaaaaagagaaaaaaaattaaatgaaatgtaaaatgaaacctgggtatctataacttgtgaaggctgaggaatagaagatacttcactgagaaaaggcagaggactcccttgactaggtgtaaggatgtgctcttgagatgctgggaacaaggaagtccgtgggagcaatggggaggaccaacacacgagcagcatctgctttgaaaagtggagactgaattgcggtttgatcctgggagcaaacaccaaagaacttagagctaataatagcgaagccataggaagagcagcaacagagaagcttgggtggaaggacttcgaatacataaaagttggaacaaaataaaccaaggagacaaacggaagtgttacacaggtatttttctttataagagaaatatattttaagagcactaaagggcctttgagctcagcttttatgaagaaatctgtttcaagatagaagagatatattgtaggtttctgttaaattaatggcaaataccactagctaagacaaagctagtgcttaagagctaagcattctttattttaattagtttattcttatggatttaggggtacaagtgcagttgtgttacgcggatatagtgtgtggtggtgaagtctgggctttttgtgtgctcatcgctcatagactgtacattgtacccactgggtagtatgtgacaccccacactcctcccaccctccaatctttggaatctacagtgtctattattgcactctatacgttgctgtgtatccattgtttaactcccagttataagtgaggatgtgtggcttttaagtttttaatttctgagttagggtctcactctgtctcccaggctggggtgcacttgcatgatcttggctcgctgcagcctcggcctcccaggctcaggtaatcctcccacctcagcctcctgagtagctgggaccacaggcacatcttaccatgtctagttaatttttgtatttttttgtagagacagggtttctccatgttgcccaggctggtctcaaactctcagactcaagcaatccacccgcttcaggcagctagggtgtgaggattacaggcgtgagccattgctcccaaccccagtttttaactttttgttgtcgagcaatttcactaaggataatagcctccatttctacccctcctggaaaagacaagttttcattctttcatatggccgagtagtattccatcgtgtatacgtaccacattttaaaaatccagtcatccattaatagacgcttagattgcttctgtgactttgctgttgtgaatagtgctgcaataaacatgtaagtcagatgtctttttgataaaataagttattttcctttgcatagatacccagtagtgttattggtagatcaaagtgtagttccatttttagttctttgagaaatttccatactgtttcccatagaggttgtattaatttacatttctaccaatagtatataaccattcccttttctctgcatccttgccaacatctgttgtttttttgactttcaaataatggctttctgagtgctgtaagatggtatctcattgtggctttaatttgcacttctctgatgatgagtgatgatgagcattttttcctgtgtttgttggccaagagctaagcattctgatggcttcgtgtggatcaaatcacagctggattgttcagttttggatgccaaatataaagagggacagacaaactggcattcatccagaagagaggaatcaggatcacgagagattagaagttgtattggtaaagggaatttgaataaatgatattatctaatctaggtgtgatagctaaatttatgtgtccacttggctgggctgcagtgcccaggtacgttgtgagacatcattctggatatttccatgagggtgttttggatgagatgaacatttaaatcagtggactttgagtaaagcagattgccttccctggtgcagtgggccttgtccaatcagttggaggtctggatagaacaagaggctgacctccccagagtaatggggaattctgcagcaaatggcctctggacttgaactgcagcattgacttttctctgggtttccagcctgctggtctgtccacattttggacttgccagctcctataatcacatgagctcattccttagtataaatctttctatatacgtatgtgtacgtcctattccttctgtttctcctgggaacgctgactgatacactaggaaagcagagatgtgggatggaggcatggtaagtgtttttagatatctggagggcttttatggaaatagacacagatttgttttctatgaatttgagagacccagatccctggattgaaatttagaggctggaagttttttttttttttttttttgcttaattgaaagaagacaacaagaattgatacattgatacaattcttttttagctgattgtgagtcagcaaaattcaaaacattgagttctttatagcttccgtgcatcaccacttgtgcaaggtactgtagaatggattcaatgtgcctgttgggaattagaattataaagaattttggaagtttctagtctgtcattgtttctggtaatgcatgctgtgaagggctaagaaatgtgttcatcccacagaggatgaaacaacagacttggtcaaaaaagtatagttatggtccttttaaatggaaaaattcagaccacagctggataggaacaaaatcctgaaaacagtgacagattcagtgtctggttattttaatactactcatgtgtagacatggatagaaaaatgcagatagtagagtaccaaaaaatacctattggaagtataaaaagaatggtaattaaatgatttctataggcacacagtctgataagagagagacctcattttatgtagctcttttactgaaaatgtggcatttatttttctgtattaattcaatgtatttcaaatgaactaaaaacctgccatcttcaaggatttcattatacgattccttatgaacactgtcataaaatgagtagttaactcatttaattttttgtgaatgaaaatatgaatggtcacatgttgaatttatttttatttttttacttttttgagacagagtcttgctctgtcgcccaggctggagtcagtggtgcaatcttggctcactgcaacctccgcctcccagattcaagcgattctcctgcctcagcctcctgagtacctgggactacaggcacgtgccaccatgccgggctaatttttgtatttttagtagagatggggtttcactatattggccaggccggtctcgaactcctaacctcatgatctgcccgcctcagccttccaaagtgctgggattacaggcatgagccactgtgctcagccctaaatttactttaaaagggttatacatgtgttggtaaatagcatcaagaaatacattccttctatgttatcgttattttaattctttatttttgtccccaaaagatttacttacagatcttggatgatcttgggtcttgaatgggcatgctgaggttctacctctgggcaggaagataggtgtgaagcaacctctaacagcttgtgcggaaaattacccccaggttagcaccagtgaggcacagttgttcagcagagcaggggctgggcattgttgtagagcagagccacgcccttccattccagagcacttggagcagttggtgtttatgctgctgggttgtttttattgaggacaaacatgcttttacatttatctatcttaaaaaaaacttaaaaactcacaagacaacttccctgatatgccctgtccccctccagctaccagtctttcccttgaataactcaatactataatgccactatttttaactcctcctcatttcctcttaaaaatctcccatctgactttggttcttaccactgcatggaagaattacctgtccacatcgcaaacgacctccttcccactatattcagtggtcagttcccacttaagtctctgaaggagctcaggaaatgacaccccaaaatacaccgctttggacttcaaacttccccagtcacttggtgaacagcaaattctgagaggagctttctgagtaccttttacctaccagacggatcctccagaggggacacaattgtcatgaatcccctccctagaacttcatcaaccagggactgctggctgatatcacaggagaggatattggagctgacactgcacccagacaggttttgtctcaggctgtcttctgtcctgctaaggggccattcacccgccctagaaatcatttactctcccctaagttgcctacatccaccctctctctcctatggagagggtatataagctttcggatgtctctgggtttcgagtattcatttttctttcatgtgatgctccgtgaatgtaatacacatgtatactttttctcttgttaatctgtcttaagtcaatttaatttgtagcccagccaaggaacttccaagagtggaaggaggccattttcacccttccagggcctggcagcacttttttgaccactttctttctttctttttttttttttgagatggagtctcgctctgtcacacaggctggagtgcagtggtgcaatctcggctcactgcaacctctgcctcctgcgttcaagcacttctcctgcctcagacccctgagtagctgggactataggcacgagcccacacccagataattttgaccactttctttattgagcttccaggtcacccttccctccatctcaggggctgcttatttccttttcctggctgcctctccagcccagggctcaagcatcattcttctgccttttcctagatggcctcattcatctacatagctttaagcagaatctgtgttctgaagacttctaaatttgcatgtcagcctctgagctttaggcttttacaccaaatttcccccagacttcacctctcacgtgcctaatgggtcataaaaaccagcagagccaaaacagaactggatttacctcttccacccctttctccctgggcttcctgaccttggtgcacagaaccattgttcatcctaatattcaggctctgaagcttgcagcgacctttggtttcgttctcacttcatagctcacagccaatccccacatcaacaagcagctcgggtttcagatgcatcacatctgaccacgtctcccctccctcaggggtcccagttcagtcagtgccatcatcctctcctacctggactgcaagtggactcttacttggcttccctgcttccactttgggtcagagacacatcatgtgtcctcagagacaaattatgagtccagagtgatcgttttagacacgggtcagattacttcactcactagctctgcactctgctaggataaaaccatatttcttactgagacactggctggctgatgtagaggcctccagcctgacccctagccttgctggggtctcaggggcacattgagtcttattgagtcccagctcctttgcacctgcttctccttccctgaaaccgtcttcacccagatgttggcttgctctttgcagagtgctcttcctgtagaccttcatgctcaaatcgttgtccacactctgtgccccttccccagtatcatgatccctgctcagtcactcgctgtccacaccctttcctttcactgagatcatagtgtatgtttattggttggcatgactattatctgtctccacagctaggatgtaggcttcactctcagggatcttgtcttgtcttgttcactttttgtatccctagtagatgctctcccaaatttagatggaatgaattaatgtgggggaggagttgttcagaatgtgatttaatacataaaaaacttttggctccccactcccttcctctctcagtttgcaatggaaagtgattgcaaagtaaagatagtacagattggtaatttggtaatcactgtgtcagtgtggctcacagtggcaacattatcacatgcagattaataaattgaggtcaacagaaactgcttctgcatgcagagaatataggaggacagagaggacagagatacatatagtgttatattactatcaccaattcagttacaatgctgttaggttttgtcacctatttttaaataattgtcctgttacatctttttctttttgcggaaggcaccagtttagcatagtttgtgcaatggctgtccattaaaatcttagtaaggtgataatccaaatcagatgctgtatagcctatgctggtttaagtcctgaagtacttatctgaaaacttcgggttaaattaggaattcagaacttttcagaattcaagaagctaacacaaattgtctttattatgtattaggtaacatccccagtggtgtctgaggcaccatcccacaaacccattgtaatttctgccaaaaaaaaatatgtacactaagtagaatcaataaatttaccagtggcttcatatcagttcctgtaatttttgccactgaagaagttcagagaagaaaagattttgtctccaaatgagtttttaaggagctttattggatgaaattactgaaacattgaaacatatacacactcaaataaaacgaactggaaccgtcgcaaaggatgcagaggaggtggcctgacatcagctgagaggggaggtcagagagaacccagggagcgagagcttcatgaaagagatgcagctggagttgcactttagttgaaggactcctctgcaaaaagctgaatcctccccagcctggatccaaattctctttcctattacatttcagctgccaaaatagctctttgaatttggtgcttagaaggatttagagatactaaaaattgcagcatttcctacagagctatttgtaagaggaaagcaatggaggtagagaagtgggttgttgagaataatagggtgaacttgaaagaggaaaagatgaggattaaaataggggcaatcttcctcatgttgaaatttctgaaattcagtattctctaaggagttgcactctaatttttcttaagggggagaaaatgaaagttttcaaatcatacacgtgcacagacacacacacctatgttttgcagggaggaatagctgagctgttagagccccacacagcaggtaatctctttggcctcctcattaacactctaatcagcccttttgcagccattctaacttaagaaaaatagtaaacctctgaaatagccttaaaaaagatgagtgtaaaccacttcagtctagcttttgaacatggtgtctattgaaaaccctattatgttagctggtaaccaacgatggaggtttcttctccagtagtaactgtgtgtaaaggtttttatgcttaggactgtgtttaggagttgtgatacattttatttagttttgagatggaatctcactctgtcgcccagactggagtgcggtggcacgatctcaactcactgcaacctctgcctcccaggttcaagcaattctcatgcctcagcctcctaagtagccgggattacaggcaagcaccaccatgctcagctaatttttgtacttttagtagagacagggtatcaccatgtcagccagcaggtctcaaactcctgacctcaagtcatcacccaccatgacctcccaaagtgctgggattacaggcgtgagccactgcacccggccaacatatcaattatttggtttgagctagcttacaataaaatcactcttacaacagagattcattgtttcttcatgtttctgtaagctgcatttaagtatcataaagtctaaaaattggataaaaatatgatgactgaccttaatttctacctccctgggacttggttctagagctgtagtttggaccagcactaagtctgtcttaccttttttcccctgataaatattcagtatttgaggaaatcatcacatctccctttagcattcttttggcaaggtaaaagactactgaatccagttttggggaccattgttaaactttgctttttcagaccttagaaacatgttaaagtcttgcaaaggagcccttggcataactgtgtgactagatatgctccaaagctctagaacatgatgatgttccatgtacgtctccatctgagtaagggggggaagagggcttggctggtgctggatgggtctcattcaatgcaatgccaaactcttaacatttgaaaattatatagtagaaatacggactttcttatgaatgccaagaaactgcttgcttctcctattgtctgaatagccagagagaatacttgcacttactattcactgaaaactgacttatttggtgataacggtttggctgtatccccacccaaatctcatcttgaattgtagctcccataattcccacgtgttgtgggagggacctggcaggaggtaattgaatcatgggggtgggtctttcccatgctgttctcgtcatactgaataagtcccacaaggtctgatgattttataagggcagagtttccctgcacaagttctgtcttccctgccaccatggaagacgtgccttttgccttctgccatgattgtgagccctccccagccatgtggaactgtgagttcataaaacctctttttctgtataattaccccagtcttaaatatgtctttttcagtagcatgagaacagactaatacatatggctaagtcagatcctaagtccaggaattccccagttctccataccttccctggagctgtatgtttataagaattttctcttcagtaggagcccttttaaattgcagaagtgctttcttctgaccacagccctatctttgagggaatagctttattgagttattgtttgcatagcatatttaagagtacagttcaataaattttagcatatttagagttgtgctaccatcaccacaatctaattttataacattcactgcatttggaaaggaaacttcatctcatctcatgagtttattttgaatgtggatcttcttggaaaagtaactgattcctcttctttacagataaagacatcagcgttcggagagattgagactgcctttgttctttattccacagggcccagagtgcatcacccaagaaagctctctgaccatgcatggtcaagtataaaacagtgtacgaatgttaaactagtgttagatgatttttgtctatgctgtggggctcacctctcccatctctcccagtctcatccataactgggtctgaactcttgcttttatttattatttaaaatttcaaactatcttgtccttgtctagctaaaattgctaatgccctttttaagctttccttaaagggatttaattgttcagcagtagaatcttttctgctgtacgtgtgatttctcttggaggaagtgaattctttcttataagtgagtgtcaaggggaaagcacagaacatcaggcttaaagcttgagttgtggccctatgatttcagttccatatacagaaatccatccgcccaacaaagaaccttctaaacattctacagacttgtccaaagtgactctactgtgtagcagagcagagaaaccaagtttgtgacccattttctggcatcctaaaggatatctaagaacctagtgatgacacccccagtccctagctcctacccccatgccaagctgtctcccactcattgcctctggatcatggtgcaacttgccactccaagaagatccacatgcaaataagctcatgaaatggaacgaggtttcctagggccatgtcctactcacatttgaatgaccatagttttagcaagatcatctttttaagaatagtttgcttctttctaacaccgaagtgaaattggtagaaacagagagaatcaggatcagaattaaagagacgagatagctctggaggcctttgaggacagtcactcccatgtgaagtgaaaacaaaccaagggtagcagtggcccctaccactgggggcagagatgctggttgctagaatggcaccaggggtacagaaagtcaccttctgctcctgtgacttgcttatcccatgctgcatgggtgtgaaaggttctgatgctactctttgtatttttggtagagagacaatgaatcagcatttcaagctacaggcaaaataaataatatgtttagacatgtcttaaaggattaatacttcagaatctgagaaagcaaagttagtaaacccaacctgggccagtggtggacacactaagataaatagctcctctgatttttatttatttatttatttatttatttatttatttattttcgagacagagtctcgctctgtcgcccaggctggagtgcagtggcgcgatctctgctcactgcaagctctgcctcccaggttcacgccattctcctgcctcagcctcccgagtagctgggactacaggcgcccgccactgcgcctggctaatgtttttttttttgtatttttagtagagatggggtttcaccatgttagccaggatagtctcgatctcctgacctcttgatcctcccaccttggcctcacaaagtgctgggattacaggcgtgagccactgtgcccggccctctgatttttaaataacatgttcttggagaaagtggggcctgaacagtcagtcacattttcttcccctatctccccttccctcctgtcccctcctatctcctcccctctcctcccctcccctctcctcccctcctctctcctcccctcccctcccctcttcgaagtctatctctgtcacccagactggagtgcagtggcacgatctcggctcactgcaacctctgcctcccaggttcaagcaattctgcctcagcctcccgagtaggtaggattacaggtgcccaccatcacgcccagctaatttttgtatttttagtagaaacggggtttcactgtgttggctaggctggtctcgaactcctgacctcatgatctgcccgcctcggcctcccaaagtgctgggattacaagcgtgagctactgcacccggccttcttttttatttttacatatccttaaggactaggaaacatttgggtcacactggtgcttacattcaaacctataaacaggaattaatgtatttctttgccatttattttataaattttattactctgtgtgtgtattttaaagaagaatttctggtgagttttctattcttatttgtatctattacttacctcaatggcttgttccaacatgattgttgtgtgtaaaagtaatttgtgaatagagcatcgctgattagtgttgtcacaattgagcgagtgtgtcccagagctttgcttttcacactcgcacactcatatggatcatctgaaaatcttgtgaaaatgtagattccattcagtgggtctggggtgggacctgggattctgcatttctaacaaactccagagagatgtggatgctgcatctgtgagctgtgctttaagtagcaagttcttatagggtctacagtgtgatgaaccagacagggccaagcaatgcaggtttccccagagatgagcacttcctgcccctcagtctgtagggattaggacacagtgcctatcacagttggcttgtgggaatatattctgggagcagaggcctgcttggagaacaaatgtcctctttgctacgtttttccagcatttaaattgatccagtatgggactgtacagatagcaagaaatgcagatgaacttgggcagtgttaaaacctggatatcctccatgaagcagattgggtctggcccatgctggtggcagtttacctcctcccgctgttccctcttccctggccactgagggtttataaacttgtgaaggcgtggagactctcaggaagttgctgccacatttctctctcttacagacgctaagattccctttcagtaattgaaagtggtctgaaggctctggaaagacagaaatgaaggaccttctttaaaaacaaacgtttacagcaccttctcgaagattcaaatttcgtggattatatgtggttattctagtgtgacatgcgaagggtggataggtacctgtttttaaaaggtatttttgttttgacatttcgtatttccattatttcaaattgcatcagactgaagtcctagcaaaagtatacattacttttatctttccattcatgggaaaatgaaagaaaatgtttcagagacttttctaaaaagatttgatctcctcagtgttaatatccttagctacccaattcagaaaattacagatttccttataattggtttacttgattatttaggatgttttctgtcatcctgggggatgtagaatgtgtgtctgatacagtgattgttagttttaaacaaataagaacatgctatatgtgacacatgcacacctcgtgagctgaactggtactttaactaccacatggcacatttattcccaaagctattgggtcagataccattttctggaaataaccgagtcataaatgatggcgtcttattggtctctacaacatgaccctaggacactttgactgctgtgaaactggcacttaaaatagagtgaaatataattgaaaattgcacattgaagatttcttattcattccttattattagctgcagaaatcatgtgtttatagacctttttcagttggatatcttttgctattttaaaatgattgaatacgttagtcagtttgactatttctgccaaggcaaaaagaagagttaattaaaacacacacacacacacacacacacacacacacacacacactctctctctctctctctctctctttttctgccaaggcaaaaagaagaggtaattaaaacacacacacacacacacacacacacacacacacacacacagtctctctctctctctctctctctctctctctctctctctctctctctctctctgtctctctcactactggtgatatcatctctgtgtagccaagcagaccactacagatcattgcttttcttagaaattacagccgggcatggtggctcaagcctgtaatcccagcactttgagaggcccacctgggcagatcacttgaggccaggagttcaggatcaacctggccaacatggtgaaaccccgtctctactaaaatacaaaaattagctgggcatggtggtgcatgcctgtaattccagctacttgggaggctgaggcatgagaattgcttgaacctgggaggcagaggttgcagtgagccgagatcatgccactgcactccagtctgggtgacagagcaagactctgtctcaaaaaaaaaaaaaaaaaaagaaaatttgagtaataaaatcagaactatcctgtgtgcctcggtacagtggagtaagaatgtctgttcctcatgctgtaccccattcaaaacagttgaatgcatggcttgagaatgggttgtaaaccacagctggatttccttggccttattcttgaactgtttgtaattggtgagaaagcagtgagcccagcagatggagaatttgctacctgaggacactcggtgtcatccaggtgctaggtgatctgactctatgtcatccttgcaccagtggaagattgggttatgcctttcccctagcaaactctcatgcagcctcctggggcaccagtgcattcatcgtccgaatgcctggctggggacaagaccagagggcctgaaggaaagctggttccaggaggaacccaggctcattcttggcctcatgcatgtgagtccttaaacaccagtttgcacatattcagtgctacactaaactctacctctgcctaagttgaatggttgtctactttgatgaaaaaaaatgtgtttaatagaggacttcctcatgtaggaaagcagaaatggtaatttacagaggataagaaaaagtacacgttaatccaagaaatacaaactcaggtggatgaactgcagaggccaggagtcagggggaaataagaattagccccaataggtctgttttataagcacagagaacaacatgcatgtaatattgtgtcaaatacttctaaaaaatgaaagcttcggcctctgtttcatgaatttctccgttaaattattcagtctgatttatgagctactgtttaatgtattttagattggggaaatcaaataggagtggggtggatgtaattgtatttattacaaatgtgagttgcttgttcattgagattattataaagttggccagagaatggattgacttttcaggtcctagacacacctgcccaggaagtaacgtcactaatagtaatagtacctggaggtagcatgagcttattgatttagttttacttctgcctgaggccaaaatgtcctgcagtagtaatgattcaaatgtacctcatggaaatcaagtgaggtaatgcaaagaacatgaaatccacatacttgctgctgttgacagaaaactgttccatgccaggcaggatctagccaacaggctgttgtagattgctgataattagcttccctgaaagtcgagggggtgacctgcagacatgtcactgggttaataatttctgtttttgtttttataacttcccttgaagcaaagttctttcctgtgtccgggtcttcccagaattggctgagagaaccgacaagcaactggcttgctatccaaagtgctaaagaatcttttgcgatgctgtgtggcaacaatgttgcaatcattaatagaactgatctaaaaggaagaaagagagaaagacaagaggcctcaaagcagcgagaaaggttgctggaggtactgttccagaatgggttgtagaactcccagctggtggacccttcacttacttcctgtgtaggtagtcaacctttttcttttatctctctctttttttttttttttttgagatggagtctcactctgtcccaggctggagtgcagtggcgggatctcggctcactgcaacctccgcctcctgggttcaagctgttctcctaccttagcctcctgagtagctgggattacaaacgtgtgccaccatgcctggctaatttttgtatttttagcagagatggggtttcaccatgttggccaggctggtctcgaactcctgacctcatgatctgcccacctcagcctcccaaagtgctgggattacaggcgtgagccaccgcgcctggccctttcttacacgttattaatattaatacaaatgtgtcaccaatttcactatcatcatgcaccaaataagtcacttcctagattaaaatactaagtctcagaaggcttaaataagggcatctacccacacgatcctgaagttctgtgggaggttgtatttatctttcacaattattgaattccttgctctatagcgagaagatctggccacatgactttccctggccaatgatatgtaggagaaagcgagtgttaggagccacttgtggctgtgtctctctttttctgctgttagatcagcatgtattttaggtacaggctgtgctgtcagcctggatcccagagggaagaagacacagagcagggtacccttggtggatgctcggcaagagccgggagcaagcctctcctcctcaggcctctagggttctggaattgattgttatcacagcataactcagcccagcctgactgataacagacatcttaagtattaggatcttcagtttatatttatttaaaatgatgttatcttgtcacattgttccaaaaactattaaatgctgcttacaaaatacatccaattcagtggaattaaaatgaataaagcacataactcataacatttttgagtaaaagaaaatgagggtagagaaatcaatcaaggccaaggctgacaccgtttgatccagtaaagtgtgtgacgtgtctgcccaaggccagccacagtgccactgtaaagagggaacacattgttcacagcctaaatatacctgactgttttcatctccagcaagctctgcacacagtgagtaatagcagagtgagaattaaagtgtgctactttatcagtagctgaacaggtacataatggccctttaaataaaatgctggattaggacacatcacttaggtctccagacttagtagagtgtcttaccttccgctgtttcttctcaacccccaagtctaaattttgattcaagcaaacttgaaagtatctgcaaggcgagaaagttagctgggtctgaggagcaggctctggccaagctgacacacccagctgtgcattttggagagtgctgcaaagcaaagtctcaccagggcctgcctctctgcctactgcatgggaacaggaagcctatcagagccgacggctttgcacgtcaggcccagcaacccaagggcactattgatctggttcaaccgatacggtcctgagtgggagtctagaggtaaggacacggtgtgtagagtcagtgatgatgactcgatggcaaggtagaaacacttcccacgctcatacaaactgtaaacccaagtgggtgtacttttctttgtttaaaataaaaagaataattggctgggtgaggtggctgatgcctgtaatcctagcactttgggaggctgaggcaggcagattgcttgagtccaggagtctgagaccaggctgggcaacatagtgagaccccgtctctataaaaaattcagattagctgggcatagtggcatgcttttgtattcccagctgcttgggaggctaaggtaggaggatcacctgagcctgggaggtcaaggctgcagtgagccgtggtagcaccactgtactccagcctgggtgacagagtgagaccttgtctctaaaaacaagatgaagcaaaatgataatctcagccacctgtcaccagcttaactgcatttctccaggtctgagaaacaaattctatacatatttttatgtctctgatatcattgtatatcttataaataatggtataccatattttaattgggagtaatttttctttataaagtggtccataaaacagtgttacatattacaatcaataatctcttagatttgatgaaatgtggtaaaagaacatttaccatggcaaaaataccaccttgcatcaggagagaaagggttctatcctgaatagcccacgctgggtttaaggagaggccttagcgagcccccagcactctgacgtgtctgacatccagtctttggacaacaatcaaaaaagggacatccaaagctggcccatttcagaaaaggcaacgcagacacctgcagtccctgacatcagtgattccaaatgggttgggactctttgatcatttttaataaacccaaagtttgcagctcaaaatggccagagccacgtagtgagtgatttgcagaagcaaatgcaatgcttggaccttcaatccccagaaagcaaggatggaatggtgaaaccagctgccgccaaacagccaggcagtgggcgtcctagcgggaaagaggaatagaaggatttgagattaagcaggcactgaacacctaggagaccatccttagaatcccagtctctttatgttgaaaattattgcctgttagaaagacctgtttcctaaggcaaagggcaaggtgaacataacatccatggcattaagatgcctaatgccaggtttattatggtatgtgtatgtgcacgtattttctatcctgcatgctaagtatttgaagtggaacttgcagacaaccatgtggagtgatggattaaatttcccctttcttaggaagttcagaagtccaaggaggcagtgttcatgaatagaaggttccttcatcttggcccggcgtggtggctcatgcctgtagtcccagcactttgggaggccaaggcgggcagatcatgaggtcaggagatcgagaccatcctggctaatatggtgaaacctcgtctctactaaaaatacaaaaaattagccgggcatggtggcgggcacctgtagtcccagctacttgggaggctgaggcagaagaatggcgtgaacccaggaggcacagcttgcagtgagctgagatcgtgccactgcactccagcctgggcaacagagcgagactccatctcaaaaaaaaaaaaaaaaaaaaaagaagattccttcatcttagcggggaggatctgaaggagtcaccctggttacatctttgtatctcaccctcacaatgctcatttagtcatcggtggatccctttaaatatcaagtatgggatacaaaaggataatactagaaaataaatactaactcagccatgctatggtttaaatatcaccaggcacacaagactcaagaactgcttttcaaatccatgaacatacgtgtctacagtcattttctagctgggtaaccctgagctggttatgcagtctctctgttagtttccttatatgtgtaacataaaataacagtaatgtgtattattgaggatttttttttttttttcgagacggagtcttgctctgtcaccaggctggagtgcaatggcgcgatccctgtgatctccgcctcctgagttcaagcgattctcctgcctcagcctcccgagtagctgggattataggcacatgtcaccacgctcaactaattttttgtattttagtagagacgaggtttcaccattttggccaggatggtctcgatctcctgaccttgtgatctgcctgcctcagcctccccaaagtgctgggattacaggcgtgagccactgtgcccggcctcattgagggttttgaggaggtttaaatgaattgatattggtgtttgatgatgatgacaatgatgatgaaagttgttattaaaccatcgctccctccctgtggccagccttcccaccttctgggagatcttattcaatcttttaactctccccttttctagagctttccttctgctttctggatcacagcactgggaatgtggatctgcttttagatcagtgctttgagaagtaggagaacaactgtggtcgtggcggttggtctttgatgccagtaagcaacagaccatctgccttgttgttgatctgagtcattgatggccagattgaaagagcagagggttcctgagtcccaggtgttgcaggacgttgtgtgtgcccacaagccaggctacatggcttagagcagcagcccaagtgctccgttggttcagggggtagcaggggtccatggagaagtcagagtcctgactgccagtgtttggaggcatggtttctgtaagcttgttgcgcagcagtcaagaaagatctggactcgaggacattggtgtcagtgtcacctacctagctacacttggtctggttgttgacattgtacttcagggctgtgggtcttccagggccaggtcagaagcctgctgatcgacccaaagtgtggatgatggaagctgtggagcagggctgagggtgaggagagaaggagcccattaaccacaagctcagagtatactctgattccctaagaaggctggtccaggaccttctgagtcaagtctgaggttctgatgaagggagaccatccgcatagtagaaggtccccaagattctgatgaagggagactatctgcatggtggaaggtccccaaggttctgatgaagggagatcatcccgcatggtggagggtccccgaggttctgatgaagagagatcatcctgcatggttgagggtccctgcagttctgatgaagggagatcatcccgcatcgtggagggtccctgaggttctgatgaggggagatcatcctgcatggtggaaggtccccgaggttctgatgaagggatatcctgcatgatcgagggtccctgtggttctgatgaggggagatcatcctgcatggtggagggtccccgaggttctgatgaggggagaccactccatatggtggagggtctctgcagttctgataatgggagatcatcctgcatggtagaaggtccctgaggttctgataaagggagatcatcccacatggtggagggtccctgaggttctgatgaagggagatcatcccacatggtagagggtccccaaggtttggatgaacggagatcatcccacatggtggaaggtccagcctggcagtgtgacccaaagtggcttccctaatctttctgagcctctgtttctacaaactctaaagtgcccactcaccaggggtaactgttgatttttactttggctccacaatgtgagtgtctggtatatttccagttacatcgtaggaactcctgtgatggcatgaggagggtgagggtgatggcatcccttgatgattcctgccgaccacagcaggtacctgcagtccctgtagttcctcagggacactcctcacacccgttagggaacagttcaccacagcatccttccacgtcctctctccaggtgaactcagagatctgttcattcaacaagaattgatggggcacctgagtcattcttctaaggtagttgacattcccagtcctgattcatggttgttccatccttatctcatctgttacctgtcaccgatcatgtacacctttctatctttgagtctgttttgcacatatatacaagtaaatcacatcgaagtttaaattgtctcattaatttgtgaaatgtgattacaaaattcttgaaatcacatttctatcctattaggaaagcaaaaaggagaaaacaattttgaagcctaactcctaagagaattgctgtattacaaggagacagggatgctgtgaattcgttacaggaaagaggatgtcagccctcatgcctttgtctcccaagggcctggactttcctccacttgatttgtagagagtgcttttggaagatgggtgtgttttatttagatggtacaggtgtcagaaggtaagaggtgtgatggaagttgataggtgactgttacttgaaggaagggggaatgaagtctaaaaggttagctacacattttatctccctgatctccctatgatgcaaagaacccaagaatgtgtctttgtaacaaaaactggttgttacatggacagtgatcagagaaatcacttgccgattagaatttctccctatgtagcattccatgaaataaacagacagctgctcctggttcccccagaaaaatacagatttgtaaaaaaaagaaaaaaaaaaatactacttgttaccaaaatgttttctgagtatattcttttatcttacagaaaacatctacgtattttaaattattgttgtggaaaatgtatacacacacctacacattcattgtaagaaattccaaagtaaaagtttacctgaaattctgtcatgctgatatttattttttaagttaaatttttttttttttttactgaaagtaataattggctgggcatggtgacttatgcctgtaatcactttggaagacgaaggcaggaggattgcttgaggccaggagtttgagaccaatctgggcaacagagttagaccgtgtctctaaaaaatattgacaagttggctgggcgtggtgctgtactcctgtagctctaactactcagaaggctgaggtgggaggatcacttgagtgccggagttcgagtctgcagtgagctgtggtcgtgccactgcactctagcctgggcgacagagcaagacccattctctaaaatcaatgagtaaataaatcataaaaataaaaataattgtagatatctgtggggtacaatgtgatgttgtgatacatgtatactttgtaaaatgtgatatatcagctttaatattttggtggacaccctttaattcatctctgttacaatatacatatactgtatggaattgtgtgtgtcataaatgaaaccatggcttctacttcagtgatatccattgtaacatctactgggaaggttggatgcccagaagatatggccaactaaattactcagtgtatgaacaagaagcacatcatgtcgtcttaaaagtgattgtgttcttatacatttttattgtggatgagttagaaaatatggagaagatagaaaaggtgctaagagtataatccaaccaccctaggaagactttgtcttagtccctcagggctgctattaaaatgccatggatcttctggatagctaaacgatgggggctcctggagggtggggctttcaggtaaggcatggataccttgccctacccatctcttcctttggtgttcatcagtatcctttgtagtatcctttattaaaaacagtaaacatcagtgcacacttaaaagcatgataattgccaaaagaatagcttctgaagaccatgggttcagaggtctgaaacttggaaatcactcaagggaccctccgcctctctttctcttgcgctgtctcccagatgctgccacaaccagttgaatggtataacattaacaataacaattaattaaataaaagatatcatacactgggtagcttaaaaacagcagaaatttatttctcacagttctggaagctggaagtccaagatcaaggtgccaatagatttggtgtctactgagggccagttttcttttctttttttcttttttttttttgagatggagtttcatgctgctgcccaggctggagttcagtggcacgatcttggctcactgcaacctccgtctcccaagttcaagtgattctcctgccttagcctcccaagtagctgggattacaggcgtgcaccaccatacctggctaatttttttcttttctttcatttttttttttttttttttttttttggtagagacagagtttcaccatgttggccaggctggtcttgaactcccaacctcaggtgatctgcccacctcagcctcccaaagcactggcattacaggtgggagccattgcgcccacgagggccacttttctgagtcaaagagggtgacttcttgctatgtcttcacatggtacaggggacgaagaagatcctttgggctcttttatcagggcaacaatcccattatgacatctccacctccacagcctgatcatcctggaaggccccaccttttaataccatcacgttggtgattacatttcaaggtacaaattttgggggacacagacatttgcaccatagcagacttacattgattttgtgctgtatttttttcctaggcctttaacttatatatttcaaaacctaattagaagggtatagttgagagacaggatagccaagtggacaagagtccatgccgagggagcaactcgtgtggagaccctggacgggaagtctccccgcacgtcgattcagagaaaggtaacggaataaacatgggagatcttggtgggagaggtcagagagagcgcggagggccagaccctggcaccttacagcatcctacatacttgggctttacctccagagagatgacgtgactggaaggtttgagtcgaggagtgaggtggcctgaccaaggtttgatgggactgccctgtctgctgtgttgggaagagaccacaggtgaccaagggctgaagcagggacacccttcaggaggctgtttctctaattcagccaacaagtggctgatgttcctgcacactagggaggtggtgatcagatatgaaaaaacagcattccaggtcagataagatgtggggaatgagacatgaggatgggccaaggatgagaccaagatctgggcctgagcaactggaagaatgcagttgcttcgtgttgtgattgggaaagctgtgggagaagcggtttggggttgaagttttctgttttgcagatgttgggtttgatgtcctgggaagttgaataaatgagtttaagagcaggctagaagttgggctatcttcttaggagtcatcagcaactagatgatgtttacagccttaagatggatgagctgagaaagggagtgaatacagatagaggagagagcagccctggggaaagtacagacttgtcaagctattgatagcatatttgcaaatggctttgaagaaagacccagggcactttcccaccagcagtgggtgggaatgagtgccgtactgcacacttgtctgttctctgtattactaattttttaatcatgaccaccttgaaagaaaagcttttcttgctaaattactgtttgaattgtaatttatttgattgtcagacagggtgaattttcataaaggtattagtcatttgcattacttgaagtgaattatgttcattttccataattctaagtcaaagagattatgttttattctgacatcgtggaagccactgaacatttttaaagagcacagcatgatgcagatggctatttgggaatattaatgggaaagttcctatccttgcatcctcttttattcattcatcagtgagtctgactccagagcttcaattttctgaaaagtttggaaaaactagctttggataattattagtcacgtgcaaatgagttaactgggtattaatggaatgaaaccactgccatttcttgctggctacagtgtgaagcaaccacttagggtcatccgtcagccttgaatcaagacacagagtacagaagacagatttccatcctcttctttgcctttcttcttaaagctaattatcagctcaatcctttatttcaccccttcctacaacaaaatgggatgcactagcattattcatatccagccttctctcagtgtgtagtcagggtagtcactggtgggtcattgtcttcatggaagatggtgtgacttccatacttagaaaccagcatcctctgatgttctcagcaggatatggctcctattgtattgtattgtattgtattatatttttcaattgacaaaattgtgtgtatttttcatgtacaacatgatgttttgaaatatacatacactgtgtaatggctccatctggctaattaacatactgcacaccatggcaactacagttaataacaatgttttgtattttgaaaatctctgagagagtagactttgtgttcttaccgaaagactttttaaaggcataaaacatgagtggttcacctgctggctctcactaaatcctctcatgcaattggctcaaaaatcatggaatagacagttcagggaggcagagtttggcttttggaattgctttcaggacctgggatatgttgtaaggacatggtctcttgaatatctggaatctgcaaaaaatgagtagtggcaactggagggactgggtttggggaaacatctcttgagcttggctctcaactaagccaacagtgccaactctgcttcataggcgcagcttgttttagaacaatgtgactaatttttttacacagttctgaaagcaattctctaaaaggaattccaaaaatattttgaacagcagcattattaagattagctgtgttccatcccaaggtgactcctgtataggaaatgacgctcactgggatgtatctgtctttcttggcctttcagaagcagtctcgggagattatggtcacacttgtgtacttgcagctttcccatagaattaaaaaccctgactaattaccagaaactcagcatttaaaatcactgtggataagagtcaggctagaactataagatcatgttacccactttctgtagggaagtataattcagcatttcaaatcagaatggaggtgcttcaaagatttgccattttaagaagaaaaaaaaaaggataacattcatcagagcatttgccaagagacagtcttagcactaaggcagctctcatccttctggaagcttgacagtcttaccatgatggtgaatgagacaagttttactatcatttcaggctcattgctgtaaatgtaacctttcttcaggtgaatgtcctaggaagaaaaatattgttccttacagaaaaaacaaacaaaaaaactagttaaagtatttcatgggaaaaaaactatttaaattcattattctgtcagattccgtggagggcctccgaggctgccagaaacagccctttctttgagcacttatttctgtgataccctgagtacacaaattccttttacaagtgacttttcctcagacaacaattgaattctaatgtgtttatcttgaacttgtattatggctggtagcctaagcattgtatttcaacagcctcttaaaagtgtccataatagatgtggaaaatcaaagtgccacacatccagttgtttttcagcttttggtgccttaatttgcatcgcctgatcagctgaggatctgctgagtgcagaaacaatcttcgtgcaccggctaatttatagcatggcagaacagttgttttctagacaacttgtaaggaaactgcttctcctcatttgtcttctgatcagagctgcacaagaactcttgatcatttacaaatgacgaaagtgagacttgtaaaaggtgagagtaaatcttctatcttattctcttattgtttgctacttggctttgatttatcattttgtgcctttttttttttttttttaacagaatctcattctgtcacccaggctggagtacaatggcgccatcttggctcaccacaacctccacctcccgggttcaagcaattctcctgcctcggcctcctgtgtagctgggattataggcatgtgccaccacgcctggctaatttttgtatttttagtagacacggggtttcaccatgttgaccagggtggtcccaaactcctgacctcaggtgatctacccactcctcggcctcccaaagtgctgggattacaggtgtaggccactgtgcccagcctatcattttgtttatatgaactataagccactagcatccacaaagggggaaatgtcttctgattgatagagcttccttttcttttttgaacaaatgctaagaagtagcaacagccaaaggacaagagctgtattgtcttctctcatgtgtggcaagaacaaacaagattgagaatctgattgcattgaagaggcattgttcattaaacttcctccagacctggggaagaggataaacttcctccagacctggggaagaagataatctgttccacagaaaatacagaatgcataacattcaatgaactttgcacagggatcccagaagtcttggctgtgatccaggacctaccatgactttctttgtttccacctcctgatgatcttaacccgtgtcatatagtttggctgtgtccccacccaaatctcatcgtgaattgtagctcccataatccccacgtgttatgggcgggacgtggcgggaggtatttgaatcctgggggcagatttttcccatgctattcttgtggtagtgaataagtctcgcaagatctgatggttttataaaggggagttcccctgcacacgctctcttgcctgccgccatgtaagatgtatctttgctcctccttcaccttctgccgtgattttgaggccccctcagccacatgaaactgtgagtccattaaacctctttttctttataaattacccagtctcaagtatttcttcatagcagtatgaaaatggactaatacactgtgtaacctctaagtttcctcaacggtaaacaagattttttttttgaccaatgatctctaaaattgcatttggctttaatattctgtgatttcatgaaaatttatattaaatttgccttatgttccatacagctctaagctgtctctggctaaaatagggaaacattgtacaggcactcccaggaagggaaggacgctccccttttgttctgtccaatttgggtaaacctttgtctatgtttatttataataactagaaggaaaaacagtacaagaatattctgtgtctttatcaacagcacgaacacttctgccatcttaaataagttaatttctctggatgcttcactatctggcgttgcaccagctgctgtgtggctctttaataggcatagaggaaacaagactataagcctttcagatcatgcaatgatttctctctaccaccccatcctttaccttttgttaaaatatttgcaatgcccttcacattgccacattctctctctctctctctctctctcacacacacacacctgcatagaaacacacaccacaggtcgtctccccttcccttttagttcccccccagcaggcagatttctctccctagccatgtcctgtgcagcctacactgtgccgcatcctgggttgtttagagtcccatagggcatggattggccagccacagcctgcaggccgagcaggcccccaatgtgtttttataaatcatgtatcgtggatcgcgtgggaacacagatgctgtttgtgttcatgctttgtcagtggctggtgcaacaacagcagagttcagttgtgagggacaaccatgtgtttgctgcagagcctaggctatttactttctgggcctttgcagatgaaagaggacagccctgctgtagggtgacgccatcatcatctctaaggactgctctcagggacaccatccctgaagtgtgagggattcaggggctcccctcatctaatttgaagcaccttttgtttttccctgtggggcctggcgacagggtacttctgtggctcagcaggcagcaggcaggtgagcgagctgtggccaggtgctgggaggcctccctgtggccacatgtagccttcgagggaatgtactctgcaggggtgtgaaagcgccccttctccttttttttttccatcaaggctgttcttgtttattttgaccagataataaaataacagtgtggaataaaataatagttgtgtaaaggaagatagttgaggttctaaggccagcatttgaggttctcttccacattttggggtaactcatgtaaatacaatataagcataacttctggaagctcattaccctaaatttgacctgctctttcccaacttattatagttctagagtgtctatttctgtaaaatatagggatatgcccaagatattcatctgaaggatcactgcacctgtgtgtgtacacactcacgtacatacaaacacgagcagacactcacagctgtcatctggaagaggagagtttctaggaccacagagacagcagtgcagaccttgttttgctacaaaacccacttgcaggaaacgaggaagcagaacactgcccagatgctttgctgagtcagggcagcgggagactgtctgtgagctgcacagtctcagcatatggtgaccaggatggatcctggtctgcaggtcacatgagccgacactgccagtaccagggaggaggctcagtgccagcacgtttggatggaaatgaaaacaaggcttcggcactgaggtagcggagggtccgtcatagcccagggtgccatcctggctggaggtgcagggacagaaggcccgggggaggagctcagggaccagccccagggatggcgaatgtcctgacataacgctgtgcccatcccagtgggtgctgaggaagctgaacggcagtgctgactctgggcacagtgatagccaaacaaactcctcacttgctgggctctgcggggcagacagtgaaggggagctgcaggtcagcagacagagagggaccagtgtcccgtgcatgccagagaaggggggggacgtgcccggtaggagggggagtgagtcatgaggggccctgtccgagagggatgccggtcaccacaccgggctcctctaaccctagcgttagtcatgtgccctcagctggaaagtagacaacttctcatgtcagcgtggcacatcccagcattgaaatcccacgtacaccggcctaacctcccacccaggcttctctccctaacctgccgcacagagtggaacctgcccctggctcagctggtctccctgccgtccgaggccccgttggcccctctcgattatgatccaggcttagtggatggcagcacagtgcatggtacataaagaaatggcatcatgcttggtacatgtcattttgtttatcctttacagcagccctgggaggtgtgcgaccttggtcccctctacaaatgaggagactcaggctccgttgcagaggcacaggggcccctgggctcacagcctggctcagaccccaatctgcagacttccccaccaccacgcgctgctctcccgttcacctgactccaagcttccagtcaaagtcggctttacaaggctttggtgggctccccagcccacacctgtgccccctgatattctaagggcggttatcacttgtagctaagacctggggctggttacatgttgcatcactctccaaaggcctggcccggagctgtgctcatgatcatcaacatgcatgtgatgatctaatcagcagtctgaaatgttatttaattttcttttatttccaagaaatctaatgtcacgtgaagcccttagtccagcacggggctgggtgcagttcccttaagggggaatgtaaagctattctgtctgtaccggcatctgcgctctaatactccctagaaaataagtaggaatcacagcaaagtgcaataggatgcaagttttgtctcctaagaagcttataaactggtgggtggagacaaggcattaatatctggatgggacaagcagggcagtgatgcagaaaaaaacacctctcagtatatgaaatgttctccaggaggtcagatgatccctgtcaggagctgaggaactgaagacaggccagcaggatggctggagcggccaggatggggctggggtggggaacgtcctgcagctgttctggggagaccgcgagctcgtcaccccacggcctccacctcttttcagtgcatagatagacggtgttcccatcttcccgcacgtagacagagtctgggactgagttaatgccactgaaatgtgagaggaatagccgggcgtggtggctcatgcctgtaatcccagcactttgggaggccgagacagccggatcacaaggtcagaagatcgagaccatcctggctaacacggtgaaaccccgtctctactaaaaatacaaaaaaaaaaattagctgggcggggtggtgggcgcctgtggtcccagctactcgggaggctgaggcaggaaaatggcgtgaacctgggaggtggagcttgcagtgagccgagatcaagccactgcactccagcctgggtgacagagtgagactccgtctcaaaaaaaaaaagaaatgtgagaggaagtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacacatgccagatcccattcaactgagggaaaggatgacataggttcaaaaaaatatatgacaggtgctacgagggctgtcctagttctctcttagtaaggagaacctctgagacaggggcaagaagctccttcctgcagtgtattacatcctattcagagtccctttctctctgaagaatatgatgagctccctgcaaaatctgatctcctccctggttggaaggaatgagtggaacctgaaaagtgtggcatttttattgtccctggaatctgatctattaccttttctgtcctctgcctttcatcttcgttctactcatgcgtttgccccagatgagcaggtaagcttttcagatctggggattggggacttcccattttagatggaagtcctgccattgggttggctgaaaaggtgcgtaaggaatctgtcagatttatcacatggaagtctagggcaggcactgaaatccttttaggaaaaatgagtttccagggtagagaccaaacctctaagtcttaaagagagcaaagcaaagaagttgacatttagatctttcagcaaaccatgaagattctctgcctgtaggtgactagatgctagaaagagcctaatggatgagttgagaaagaaaacagccgagtcaagattgctaatgcgttcattacatgcatgtgagtgctttgctgtagaaagttatcgacgtccaaccccatgagaccattactgtcccatttagcctgacttctctcacacggcctcctctcgccttccctgcaacttcatttttagtttcgtattcctcaagacctatcccttaaagaaggaaagcaaagaatggtggaaaaattcacatccataaaagggtttctaaagctaggagccttgctaagctgcctgagttgtcacattgcagagtgcacggaatggccggctgagtctcatcagtgtggtggtggttacacacgctcattttgcctgatcaaatcgtttcattaaaaattcttaagctgtagacacaaaagtactttttcaaatacatcagtggcaatacagaagtagactgtaattcatttgtgtgcacttataatacaacacacctccccaaataaaatgcattttttttctgggtgttcactgcaatttgctacaatcagaaaaatcataaagggtagaatgatgtcattttttaatatattattttcatttttcaatgcctcgaagaaggtgcattaagatcatccattaccttagcgatagtactgttagtcccatacttcatatacagtacaaattcgttattatcagttaatattgacttagtgctcaaagtgttctagataacacacagtctataaagtacaagcgttaagtcacagccatttgcaatttctcttctgactgccaagaattaatctcttattcaacaaatattgttaagtgcctgctctgtgccacagttgggagcaaaacagacatggcctcggggctcagagagtgcacagctttccagtctagcaacaaagtcagacgttaaaccaacaattactgaaattagtcttaaattatagttgtgacagagacacaaaggtgagtgtggggcactgtgaggagtctgaaaaaaaaggacctcactcaggctggggttagggattcctccccaaagactggtttctttgaatggtttcattcatttgcttgccatttatttgaatgtgtcaagtcttgtgctagatttaagaagataagaaggtgaataagacagaattctgattctcagggaactccatgctctcatatgaaagacagctatgaaagcaaataattgcacagactttcatcatatcactttattgcattttgctatgaaagatactatgctgacatgcctcctggaaagaggaaccagatggaagctacacagattagataaaccagctggatcttagaagatcagttgataacatggcagttcatacagcatgaagttttctcttactaagctaaagtcgagaaacatgcccgatcgtaaggagcatcatcaaagtggcagaaggtgtaaagggaggttagtgttttgactgtatgctgggccagccaggacaagacatggcatggctccttctcacaagtaaaatcatgctaacaatgcactgtggccctctagcttcctcctccctcttttgagtctgtctgcagggaacaggcttttacagttccaggacataggatgcagaaagcacccagaaggaaagagggaaaactcattttgtcagtccaccgaaaagctggtgctgacctagccatgacagcacttccttccaaaccagaggatctatttgaatattggccaagggtcacagacatggagttcccatatatgaaccctccgttttggctttggtgggattgatatggacaaaacacgccgcaacttaagtgttgaagtcaagtgttgaagtcaagtgcagagtcacttgactctgtagcaatattgtctcaacaatagactaagaattacttgtgagtggttttgcactgaaatagtctctatgaggttgtactaggtgggccctaattttatagctaggggaactaaggtcccagagaggtgagctgatttactccatgtttcatgacacacagaaacggggatgggaccacggtctacccaccccagctgcagtgactgcaccatgggaactatttccccttgcatctccctgtaggactctgatgattcatgttgacatgtgttaaatgccagaggtgaagactttgacccatagagaagagagcccacctggggactaagcaggacttagttaccactccagctgccacctggagtaatcttcctgtctctactctttaagccccaattcatgtaagatctgaataaaagcggtgtgttcgccaagcatatgcgcagcttcaagacaaggtgtctggccttttctttcaaccagattgcagctccgaaatctctcctgtagcgaaacctggaacttccatagacattggtgctcccatctctgcacatgggagagggcacagtctgttttccaggagtgactgattgccttcaatagatcaggaaactaaccgcggacagaatcagttctacactgattttatactgtgaatgtttaaagtgaggcgttgtccctaacggaagggttagagaaatgtgcattgcttaatgggtttcttatgaagattaaatgagttcgtgcatagcaggcatggaacacacagcagtggctagcacaaaaatgagcccttgatgtgttggaatgtgttgtcattgtaaaccagccactgttggcaccagacagcctcggggtgctagagctgcctgtgacccacgaatgccatgtgaacaaactgacacagccatggcattttctctaaagcaaacacatgaactcagcaggtccctgaccacagatgtccatggtgggaggtggtgctgggtgatgtctgtaatgaagcagagattcctgggcccctctggggtttggtggttaacaattcatcccagtagtccaggcctggatcccacagccatggaatgattccctggcaggacactgctggagagagagggccccacagactccatcacttgggtgacctttggtataaaaggaaggaagaaacaggaaacaggaggtgactgcatttatctacagcagcctcagctgtctcttggcctctggggtccatgctgcagctctgagtctttttcagaaacgggaattcaaaggataaggttttaaatcattgaccatagagctgaaggtgtatcaggtacacagcaaggtaagaaatgcagtcccaatcttttcactggagtttctgcatggataatcagaggagttttcagaacatgctagataagaaacaatctctcttgcactcctctctccctctctctgtttctgtttgtctctctctcctttcctacacacttccccaggaaagttcgatttccataagctcttgtagctgcatattttacctgtggctgggaaaaaaaaggaatgggtagcaagccaagcacctctgaagcgtttctgcaatggcaacttaaatcttctgtgaaaagatgctggatagagaatactggatgagctgctccagtgtggaatggtgcctgaggaattgctattccccacctctattcaatttagcaccaccgttgtgcatgtttcgattaaaaagaggaacaaaacatttatgtactcattcaattcaccgctgcctttttatcacgcatcttctgtgtgccaggcaccaccccacgcctggcatcctgccaatggccatccttcccagggctggattttgcctctcctctccttgcgacttacaagaatttgcatttaaactgcacacttcacctgttggttgatacccaaaaccttcttaagagggaagaaagcttcttcatgacatcctcaatgacacgtaagtgccagttccctgtgagatcttgagggtgtggacaggtggccctcagaggcattggctggaattggatcctttgctgaatgctgcatactttaggaatggacggaggagcttcctgaggtggagaggaggtcagtaatggggaggagagagggcaggaagggaggcaggagaccggtctgtaaaatcaattttcccaactaaaaatgtaatgtcaggaggtagctgtgctccaggctgctcagatgtacatctaggcctgtctgtgtgacactcttgccagagcgggctgtgtcttgtgcagtgggcacaggaaggtgggatccctgggctgctcacgaggccgccccacactctgttcaggagacctagttatgagacggctgcctgtggttgcctaccattctgcctcttccctgccacctcatcagcacttttacctgtcgcctgcttatttaaacacgtggtccagcaatcacagtgagtgtggtgctgactgttgaatgcccatgctcagggaggcccttcacaaattctcagcaaggacttctctctgatgcatggttgacctgatgctaatggtcagctggccccagcgacactctggcattattttaccccctctacactttccctagattcgcctttccatcccctttttgaccgttctgattttgtaaaagccttgtttttcaggaaataccaatatacccttaataaagttttattaataaggtgtttaaaaaggacccagagtcaatgatttcatcaattagagcacgaaatacaaaagtctgaagatccaaaggaatgaatctctaatggccagctcatgacactatgtggcagctagggagatattttcgggcagaggtcttcccttgcctctcaaattctagaagtaaacatctgttgattttgtaatcaacaaaatgtattatatgtccgagagagtgacttgtcttggaaatttcagacatcagatcaattcggtacttgagtcctataccagggccactaaaggacttccagtccaaattccatcaaatcatgtagagccctcttttttgtccttctccatttgctcagctgtttttcctcccaagtagggagggcagggctgggaagcttcatcaagatttcctttgacacgctctggcttcagatagtgatttactttctaatgacgtgcctctgttttcattccctttccagtgtcaatctcagttgcaaacacccccaggaagccacacactcagctccattcagctccagccgtggtgtgaatgaacaaggaagtgagaagagtttttcattgcttattgccagaaaaatgtgtctgccagcttcagtgtttataaaaagcaattttgcctccccctaagctagcagtgtttaataaacatgtaatagagaatgtaggtttaatatttaagcatctctatgccccgagtctgagtgatgctctgctacattctttctgcaaaagggaatttaaaagaatgatgagatccagccccggcctgaaacaaaggcagttccagtggagtctgcagggttcactctttccttccctctctcctcagatagctgctccacggtttccccacttaggcaaatgagcatctgctgtgttcatggaaatcggtccaagtaacacaatagaggctgctgctcctggtgtgtgaaatcatcccccgaattatcaattgaaggaagattgcatcgtaaagccctggagcacgagcctcgttagcacgctccttccagcacagccggggctcggtccgtctggccatgtatttggcaaccagtgtgtgctccggcccaccctcaactaatgggtgtttgcatgggtgtgcgtttgtgcatgtgtgttcaccgccactagagtgagttcttttttggcagtttgtttgaacatatactcacccgaggcgtgtgcttggacctgtagatggacaaaagaggaaggcagcagggccctgccgggtcatgtgatgttgcagcggtgttctggaggacaccaggagggatgggaaggcagcgagaagagcgtgttggggactgcggtggtgacttctcagccaccttcctcgaaggggtggccttctccttagagggatagccagtcttgctgtgacgtggactgggagggtagtgccagcacacaaggaggaggcgggtgtggtgggaggcctcacaacacacggggccttgcaggccataactaggagggaccatcagtttcttatttttgtgtgggttttttttttttttttttttttgagacagaatttcggcccactgcaacctctgcctcccgtgttcaagcaattctcccacctcaacctcttgagtagctgggattacaggcacacaccaccacgcctggctaatttttgtatttttagtagagatggggtttcaccatgttaaccaggctggtctcaaactcctgacctcagtttcttgtttttgaaagatactcaggatgaggctgcagacacaggaactgtctttctcttctttgaacaaaccaagctgttttttgcctcaagcgctttgcgttctctgttcctgctgctgggagcaccgctgtgctttgccctgtccaagatgtgttctttcccacaggtgttggcttagggtaactgactcaggagggtcttcccggcagactgcaggctctgaagggtcacccacccttgcgtacactcatgttgtaaatgagttttgaccctgctggtgccaacaactgctgctctgtgtgttcttttagaatgctgcctggcttggaatgatcttgtttctgtttacttgttgattgtgcatctgctttcttctctttttgtattttttgtgagaagacaggtccatctccctagtttttccctctacggaagttcccagccatgcctggtacagagcatgctaccaattaatatatttctaatggaagccagaagctgggagtccaatcagaaggcgaattgaggtatcacagagcaggaagaatggctgcttggactacatagaggcagtggagatggaatgaagaggatgggtatgttttgagaggaaatggatgacttgtgagactagaaatttgggaagttagaaggatagaggaaatggtctctagagagcacctcgtataagaataagaggcacagggttggcggtggaggcgcttggaggcacagaagggtgctcttcctacttttttcttatcgtaattctcctctgaggatacaagtaaaggtcttattcatgtggataaaattgccaaattttatgtttctcagaagcagttttgtgaatcagtaagtgtgaaggaaatagcccaggtattaaagggaggaatctggaaaggtttgggccgagcagcttccaggggctttgtggccttgggttatccttgtcctcgtctaacctgcatgccgtgttgactgagtatggaattttccccaaatctttgtttttattgacgtagaacacgattgattttcaatcagttgatcaaattcctaagtggagcacactggaatgtgtgtggccaccttctgagggttcatgaaaaagaagtggaaggattccaagagcagccaggctttcaccttcattgaagctgcagcctcgtccatcagaggcacagacacaagaaacatagctctgagcagaaaacacagaatacagctgttactggaaaggggtccagtccagacctgaagagaaggttcttggacctcacgcaagaaggaattcagggcaagtctatagagtaaagtgaaacttgattagagaaataaagaaacaaaagaatggctactccgtaggcagagcagtggcataggctgctcaattgagttagttatttctggatcatatgctaaacaagggctggatcattcatgagttttccaggttggggcagagatttcacggaactgagagttcctccccatcttagaccatatagggtaatttctggatgttggcgtggcatttgtaaactgtcatggtgccggtgggagtgtctttcagcatgcgaatgcattataattcaagcagtgaggggtcactttcattgacatcttggtttcgatgggttttagacggcttctttactatatctcattttatcagcaggacctttgtgacttgtatcttgtgctgacctcctatctcatcctgtgactaagagcacctaacctcctgggaatgcagcccagtaggtctcagccttgttttacccagcccctattcaagatggagtcactttggttcaaacgcctctgacatagctgagcattaagtaccatagcagtttggataagtgggaagtaattgatatggatgggcacaccaggtggggaggactttctggaaatagtgatacattgatggtaaatacgatttggctgtgccaaaaagatggagaattttaggcagagggagcaatttggtcaagtgtgaagacagagctgaccatggagcagtttaacttttcccgacataaaatgcgaatttccaagctgaagaggagcggatctagagcccaaggtggctaacgctgccataagctagtttcagtcccgtctttgctgacggtgtgatattcctgaggccaccggggatgattcacaagggtgtgccgtgattccctttcacagaagcagtttaaaaataaaatctcttgcactccctcttagccaaaggaatccattgaaagccaccaatgtacttcgctagcagtagaagcgtcccatttggtggatgatgcctttcaaaccaggatcacttactgcattcctttcccagagctgccgtaaccagggacctagacctggcaattttaacagcggaaacctactggctcacagtcttgggagcctgtaggtctgaagtcagagcatcggctgggttcattccagggctgcgagggagggtctgtctcaggcctgtcttctcggcttgtagctggctgtctttgtgttcacccagcattctgctttgtagaggagtaaaaataaaatttacctctatcttcttaagttctctagccaggccctataaactagactggcaaaaaataataataataataagagaaaattacacagatttacttaataagtcccatgtgatatggaagccttcctaaggcagtggagacctgaagagacagtgaagacctgaagggacagtggggacccgaagagacagtgatgcctcagcgctttctgtagtatgctggatgaggacgcagaggtcatggggaagcgtgacaggacaaagggagtgagctgagggtgatcggtgggaaccgcagcaaggtctgtgtgctcagcctcctcccggctgcctctgcctttggagatggggatgctgtctccagtggggcatttggagggtgccgctcacaggtgggtcctaggacctccttctggggaggcggggaagtcggatggtccttcctgcgcctgacactgctcacattcttccagcttataatattcagtatgccaaggtagcatctttgtggtagtgtgtcctgaatcacaccagcctctgtgccagtctgtgtccacatttccccttctcataaagacactggcatgttggattagagccataccggtgacctcatggtaacctagttgcctttggaaagaccttgtcttcaaataagctcatattctgaggtattgggcattgggacttcagcatatgaatttgaagggatacaatcaactcataaaattgccatgattttttttcaaataagctgctatttacttttaaaaaataaagtccaatactgtggccatattgctttctgtcaccagcaggtggcatttctatagtccagggatggcaaaggaagagccgagtgctttcctgttgttttatttggaaaatgaagcattgttatgtacgggtgagagagagagcacagattaaactttggaaatgatagtcaatggtacatgatgatgcatggagacttttgccataaattctagacatattacaggaaaaccagcaagcccacaccggttcccatggaagtcaggaatcacactggcttctgggcttgaccctgtcaataaccagcttccaggctccgaccaaaacacttagaaataggaatgttaatactgagataattgtggcccagagacattttcttctctaccttcctcactgtttttttatttttattttttttaggatcagatgagataaaatatgtagacttattcaaaaatgaacaaaatataatacaacttaaacaaaggtcccacttacctgtcctctataatatagactaccttcccttcaaaacaccctccccgagaacagtaactgcgaggaggaactttatttccttcaagcagtaatcaagcctggcccatacgagatattaaacaggcatgaaataaacaggcacaggtaaagatgactgaagaagttattctgattcacatttaaggattgacattacttcaagcaaaattgggaaagaatatgaaacaaaagacgtgtggtctctactctttaaaagctcacagttaattttgctgtatttttaagagaaaagcaaaatggatatatataaaacagattaatagacgactgaattgctccaaaatcattcattcgtttatgacacagtgcggtcctgagactcctcctgcaggcagctggggtggtctctgcccggagcatcggcatgagccgcactgcagtggagtgagtgttgcctggtgttgcccacactgatggatgtctggaagtgcagctaagtgcagccacagagattcactgtaagagcactggatcctttactctgagaaggagatgtggcagtagcgcctggtagcataggccccgtggccccttgtccctgaagcttcttccgttaacagacctcacagagcccagccctcatttccttgcagctcaatccatttctttccagtctcggagatgcttttcttatgactcaatcaagggcttgcatggtgtgtggtgctggcactgctttcagaggctgcctgatgattccgagatccctctgctactttttcgtgcctcatgcgtcttagggaaggtgtttgcaggtgaaggaaaaggtgggtagggtagacgttcaaagggaatcatgaacttgttttgtgtctcttcaaaaaaactgagcaagctgattctcacacacctaaacacgaaagcattttgttactaagctctggactgtaacaccccaaactgcatatgtccctgataaactttattttcctctaatcacttggaagaaccgagtttactgtgtgtaactgcaaggggcaaagagacattggtgagtagaaggtagaaaattcctccttgcatgaaagggaagctggcttctctgtaacaattgttgctatctaaagctagtgggaaccagctggtgggaataaactaagcgccccttgaaaggctgaaacagggtctggagggtgagtggctactctagggggatcccagcactgggttagaggccaagctggattaatctagtcaacacatctctaatgttttcctagcttgagtcagcactgagtcgatttggtataagaaagaaaggaaacatattcctgtggggagacagacagggcaagagcacttcttataaaaattagcatacagagggatcattaggctcagcctcaggtggaacaggtgcctactggaaggagcacctcggtttacctggggacagggtaggaaaggtttcaagggacaggaggcatttaagaattaaaattaaacactgaggcttctgggttgaataggagtttgtcaggtagacatggtaggaagggagtccaggcagagatggcggcatgtagaaaaataacaaggcccaagagagccgctgaaacttcatggaatgttaggtgtgagacaagaggaggtagagctggactaggaattggaagcctggttttgaagatccctgtacgttatgcgccgggagtttgtaggtgatgaggaggtatgacataagtctcagcaggggactgccacgatcacatatgcttgttagaaatatgtttgcaggtggagaagagactggtgagaagtgagggtggataaagaagcggtattgagaggtaataccacagcccaggaaggaacgcctgaagtggaaataaggaaagattggcagccccttaggcggtggactcagatggactgtagcattgcttacagagagaggagctgtgagaaaataagtgtcctatttcttaccttgccagttgggtggatgctgacctcattcaaggaaaataagaaggagcagagggcagagaagatggagatgcagacatggacatgtacaatggcaaggaacatatcggtggtggatgcagtaaagagttggctctctaggtctggaacatagaggtcgaacctgaagatcaagctgggggtcaacatgtctcgtggaatgcaagccacgtaggtgtgcgtgcggtgccctagggagagaagacaggatggagcacagggagcggccaacacctaggtgagcagatagtcttccctaggacagctcacggcagggagagaaaccatgagacttgagaagcaacagaagggaatgcagtgagggaaacatttcaagtaagagggaagaaataaaaaaaccggaggtcaaagacaggccaaagttcccattgtctatccactgcactttggtggccctggcgagagctactctgcagaaaagtgagaagtgaaaatcagagccctggggctgagaagcgcattggaggttaaaaaaacccgggggagtgagcgtggaactcgccaacacgcacagttgctcaccctagcacaggtgcatctggacgcaaagcaagggggagagtgagggagaatatctgacctgctcctgtttcagctgagattccagcgggttagaagcgctcgaggtcagtcaggcaggagctggtgagatacacgtatgggggcaaggaaacgctacgagactgaggattgagctccactcttttccactctgtcaccgaatgtgtcaccctcctcaaatggagtgacccaggtgtcggggactctgtctcagtctggatccctccccctggcagtcgccactgacatgctgcagctgctggatgtgcaaataactgatcagccttgctgtccaggaatttacaggcgtggtgagattattttattttattttatttctggatactatcctaaaccttcccacaccaaacacaagaagttttcccttgctttcttcccccactccttgccttggaacatgataatcaagaaaaactgaccaggtgcagtggcttacacctctaatcctggcactttgggaggctgaggtgtggggatcacctgagctcaggagttcaataccagcctggtcaacatggtgaaaccccgtctctactaaaaatacaaaaattacttgggcgtggtggtgcatgcctgtagtcccagctactcgggaggctgaggcaggagaatcacatgaacccgggaagcggaggttgcagtgagccgagatcgtgccactgcactccagcctcggtgacagagctagattctgtctcaaaaaagaaagaaagaaagaaaaaactactgaatgaatctcattaaccttttgaacaatcctgtcactgtgggaagtttgtcctcgtgggttgtggtagaatgtagacctcttaaatacaagacccagctcctgttagcctttgtgaaaagaatagtgttttaacacttagtatatgctcaattaatgtgatatcaaaagcaattttctaccatttgtgttatttcagcatagctgcctttcatgtgtaccctgcaaccacattgtgaaatagacattttcattcccatttcacagaggattaaactaaggccagaaagattaagaaactgtttcaaagctatataggctgctgatacatcacttatatcactaggtaaatctcactcagattcaaatccagattttaattctatcaagtatatgcaaattaaagaaagtgttttattatttttttcctggaggggattccaagaagaagggtaatcgcattttccaaattcagactgtgatgagcacagtttattacggagcatccatccccacatggggtgaaatgtggagaaccaatgtcttatgagcacctttgaatgaaaatcttgagtccttccagcagagaaaggactttttgaaaggtttatttattcctttactacattccattcttatcttattaatagttcataagtctcagctaaatctctaggtcatagtaaatcacatccttcactatgagaacttgagatgacacaagcattcagttatagcaatttatagcaaatgcttaaaattggtatacccacaatctttcaaagccctgtcaaatacaggagtcagtcagatacaattttaaaaggcttaccatagaaagctctaaatctttgcatagtcaagcatatcttaatccaggagaaaattatttttgtaaacctttcctagaagaattttatgtcctgtattacaatcttataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgtaaatgtcagctaattacagatctccatcgcttctataaaatgccttcacttgaacacccagacaagtgtttgaccaaacagctgggcaccatcgcccagccaagttgacatctacaattagcccttacaagaaaatgtcctttggactataatgtttgtctgtaaagtgtcactatcgcaactatgatgtgtgtttctttggacaaaatatacattagttgaatagtaaactctgaccaaagatgtttagtattaaataactttcttaatagtcaaactgcagaactaaaatttaaatttctactaaattttgtgtgtgtctacccataattatctgctgattctcatactttacatttgaaggactctaagctcctgaatacagtacagatattcataatttttggagacggtttaccagattggcacctcatgaaaatggaatcaaactgtgatgggtaattttatgcatccacttgggtaggccttggtgccttgatgtgtgttcaaacattattctgggtgttttgtgtgagtatttttggaagagagattaaatttacatcagtgaacttcaaataaagcaggttaccctccatcatgtgggtgggcctcatccaatcagttgaaggcccaaatagagcaaaagactgaccgccccagttaagagggaattctccagcagacggcctttggacttgatgcacctctttcctgtgactccaacctgttggtctctcccatgcaattttggactagccaagcctccacgatcatgtgaaccaataccttaaaataaatttcttcgtctttctaaatgcatatatcctcttggttctgttcttgggagaatgctgattcgtgcataaacaaggctgaaaggcaatccttactatcgggaaggtaagaaaaatgaatgcaaggtgtcagaagtgatggttggtgggtgtgtagcattggggcaaattgatatttaaaaattaaactctgttcggctagccagccttcttcagtcttcagactgcgagaatgtagcatctctgaattttaacagggcatcatcaagttctgtcataatgttgttatagataagatggaggaaaatcttctgggaggtaggaaaacaaggggtagattaatgtaaacctagagggaaagtcctagtaggtttttagggaccactgttctttattgtgtcctagtgaatatttgtctagatggcttcatggagaaataaaatcttcgtggataaagaaatcatcatcattatcaccgtcatcattaatgggtatgagtacttaacatggcctattttgtgctttatatgtgttaccttatttaatttttataataatacttgttagaataggcattattgttgttatttatttatgtatttattttgagatggagtcttgctctgtcacccaggctggagtgcagtggtgcaatctcggctcactgcaacctctgcctcccaggttcaagcaattctcctgcctcagcctcccgagtagctgggattacaggcacccgccaccacgcctggttaatttttgtatttttagtagagatgagattttgccatgttggtcaggctggtcttgaactcctgagctcaggcgatccacccacctcggcctccaaaagtgctgggattacaggcgtgagtcactgcgcccggcccgttgttgttattttagaattaagaatttgaaacacagaagatgttaacttgggaaaggtcacacagtggtaaatgggagagcagggatttgaactcagtaagtatgatttcagagtctacactcttaacccatgtgcactctcagatatagctactgaatcagaagatgatataaagaaggaggaagtagtgattgtgtggagtgacagatgtggcccttcatcccatcccaccaggattcctttggattgtggtcctataaaggtgcgtgagaagcagatggatgttcagtaccgcccctgggcccagttcacagctgcaaaagtaccggatggagcagacattaaccaagagtcctgtgaccgagccaagggtagacccaatacaacctggtgtaggaggcagtgaagttgacgaacacttcggctgtatcatcagggaagcaacacttagatgtgggcaggtgggggctggtccagtccatgctgctcagaccccacctgcaggggtgctcagtgtagaatcaccattcagaagggagactgggctgaccacggagaggcaggagacaaggcaggacatggaggatggacagtagtgcggtttgaggaaggcctgaaagaattggcagtgtttgctccagaaaagagacagcgaaactcagggctggggataggagatggacgagcatcatgatagcatctcggcttacagagcatagaaagcccaggtgataggtcttcctcttacctctgcagcaagttcatggtgtgactgagggggtggccacagtctcaaatagcttccccaggtgggtctctgtgtcacaggccatgtgacttcaggatcccaagatgctcattctggcacatttttcagcaggacccaaaggatcaggctgtcttcagctgctaagaggaccagtcttttgcgagtctttcttactttcagcctgtcattgggcagatttctgaagcggaacccagtcctggcagcaatctttcttctgtctcagctaatcccagcctcagcacacagtgcaacattttcagtggtcttgtgtctgtaattatctttcactgtttctagaagcaacttcattgtgcaacaccattgctgtctggaagggtcattatctggaatcggttagttctaaccagctccttacaaactgcctttggtagcaaggctcttaggatttttagagtgttaaaaaaaattccgaaacccagatatgttcttagttgtaaattctgactaataataagttataagaaagaagacttcggaaaagtgtgtttgtaaattctttatattgtttctaaatggggtcgattacctgaggagagatgagttcctgccactggtgatgttctatcagagagacaagcaaaacatggaaagctgaagtaaaataacctcagggtaagagggagaaaaacagtaaatggcatgggtgtggggttcagggtactgagatgtcagaaaaatcagtacagaatgtgagggagaaggtgtgaagagtccaaggacgccacctgctcttgcactccgaaccctccccgctcactagcaagtccacagactgtctgctgaatttgtctacaaacagaaaacaaggcactgtggtgcctgttgtatagatgagagagcataggcttggggatggtgaaatgagccttctccggcctctcagactcaggctttcggagtttttgaataaacctaagttagtccacttcccggccacatagaagttggagcagtaaagctgatgggactgtttttcatatgagatgcaaactcctcaggttatggcaagtgagggcgagaaggaggcctgggcaagagaaaggacttgctttattttacatcgctagtttatggaagtaccagccaacactgaaacttcctggcctccaatccagtggggttattcatcctactctccactctctctgttttctgatgtttggaaataaaaaaaatcagaactacctcattaacgctctctttcctctttcatctgaagcagtgtgttagttaactttctcaacaagtttacatgccctttggctaataattgtggagaggacctatgactcactgtcattagtgtagactagctgccctagaaaaattgctcgggcgcggtggctcacacctgtaatcccagcacttggggaggccaaggtgggtggatcacctgaggtcaggagctcaagaccagcctggccaacatagtaaaaccccatctctactaaaaatacaaaacttagctgggtgtggtggtgggcgtctgtaatcccagctacccaggaggctaaggcaggagaatcgcttgaacccgggaggcggaggttgcagtgagctgagatcacaccactgcgctccagcctgggcgacggagtgagactccatcttaaaaacaaacaaaaaaacaagcagatagaccacaaaatagacaatggcttgaacacaataactgcttctgttttcctgtgtaagaggttagtgaggcaggcgcagggctgggggagtgcacttgtaagtgggctttgtcatcttcacagtatttttccaatgttgtcctgaagcgttgcctcattccctccacccgagcaggtagagaacagggaggaccccatgcaggagctgttgcggttctaacacgcatcctattctcttgggcagagctcagtcactcgaccatgcccagctgcaaggcaggctgggaatgtagactaactaggtgggtgagccagggaggaggaggagacctcaccctagccccagctacacttgcaggtcgagccaagagctgagggttttgcatatactgggtacactgattcctgttgagtctgcagcctgatttattttgtgaaactctagaatcatcggaggcggggttgcatccttggtacagccctctttatcattgccccatggctggggctggaggacagcaggaacagacactacaacaaaatcagctctcttggctccaatccctgaaagcccattgctatttctccctgaacatctggcctgtttcctggggtgtgtagagagaggccttctgttccttcagggcctcagctcagcacctgcgaacacagacattaaaaaaaccctcaagaactgcttggcaagcgcttggaacacagtctgctcagtatgcaccttcccacaccccctgcttgtagtaataatctttacctgcttggcagagcacgccgttgaggggatacatcacttcacctgctgagatgagtgcagagattttctaatgagaggcatttggtggcaaaaattaattatgacatatttcaaaggcaggccaagaacctggcctcctctccgttcccatccgatgcttctggtcactaagggaaagagaatgacaataacaataagtcaggacttttttttttctgttgtataaatagcagggaaggctggggcttctgacttcagcaccacagaatttttctgcagtgcctctttccctggcacatagcatgctcgttactaatgggtcctaaatgaaccccaggtgtcctggtgctcacctgtgggttgaatctcccttgctcagtaagtgtagaatccctctagggtccacctattttggagggactcaaactaggagtcccctaattgcattcttaggagaaggatatgacttcttgagatgataaaggagacattacctgcagacatttcaggtggaaagccaaattgtgaactttttcttgtgcagcttctccatcagcacttgctgcttcaccttgcactatgttatggagatggttttgctccttaaacctcatgagccaatctttgctagcttccagcttttcttctgcagcttcctcatttttctcagcctccatagaattgaattgaagagaggtagggccttgccctggattaggctttgtcttaagggaatgtggtggctggtttcaccttctatgcagaccactcaaagtttcttcatgtcagcaataaggctgttttgctttcttatcattcatgtgttcactggagtagcacttttaatttccttcaagaactttgcctttgcactcacaacttggctaactgtttagcacaagaggcctagctttcagccgatctcagctttcaacatgccttcctcactcagcataatcatttctaatttttttttttatttaaagtgagagatgtgtgactcttcctttcactttgacactttgaagctattgttggttgattagctggcctaagttcaatatcagtgttgctttttgaaaagagtaaaaaaccatttggagccaaatcaagcaaatgaggtgtgtgatcaaactctaatcacttagatatctgatatcacttagatatctgatatcataaagtaaaactttatgaagtttggggtacctgtggccatttcttaaaataagacaacagtgaggtttgccccactgattgactcttactttcataaaaggttctctgtggcacgtcatgctattttataacattttacccacagtagaacttctttaaaattggagtcaatcctctccagttgacttccttgtgtacgcataattttataattcaaaggcctagttttagttggacaaaaacacattggtcacattcttaatagccgcaccccaagtgagccaggaaaaatgcttgtaggaaaaagctgtaggaatgtgctcttcaccttcctgcaaaagattagggatggttgatatgtgagggaaggtgaaagctggaaagagtgagtgataccgaactttattttttcataggaaatacaatatttccttcactgagctgactggtcatctgttggaccccagcccagctcagcttagcagcctgtctgtgtgtgcacgtgtgtgtgtgcatgtgtgtgcgggtgtgtatgtgtgtacatgcgtgtgcatgtgtgtgtgaatgtgtgtgcatgcgtgtgtgtgtgtgcatatttgtgtgtgatttctccaggtgccctcatactgtgtggggacaatgagttgattgctcccctgctgtgtcactgggtgatctaggattatatcactgcctgaggacatgagtaccttttcctttgctgtcccctcaggaaaaagcccagtgtttcacagttggctgtccaaagggaggactgttctccaaccttcctaaaggcccatgtgtggggaaggatggcagtgcttctgacattgggcatggcaggtatgttaatgaggcagctggaaagccatgcccggctttgggcttccatacatgtgattatccctaacaccttcttttatgattattaggctttgaaaattgctctgagctatttttaagaagtctcagaataaaaagagatgatctgggaaggtgagaggagccgatgcccagccactgttaagaacaatggtgtttggcatttatctaggtctctcatcatggttcaggcaggaactccctagccaggtggaacctgtggcaggaatccacaagctgtgagttcaagcctcatgccagctgcctaagctcctatgagaagttggtagatggttcatgtcctttttcctcatttttttattttatttttttttaccagggccagtcttctgtgtaggcagagtgggcagaggcacagatcgtgtgattctaggtttatggagagcacgctcttttcaaagagcttccctcgctgctgtctgtgagtttatctgtgacctgctacagcagcagtccccagactttttggcaccagggactggtttcatggaagacaatttttccatggaccggggagtggggtggggtgggatggtttcaggatgattcaagcacattgcacttattgtgcactttatttcttattcttattacattgtaacgtataatgaaataactgtacaactccccataatatagaatcagtgggagccctgaacttgttttcctgcaactagacagtcgcatctggggatgatgggagacagtgacagatcatcaggcattggattctcataaggagctgacaacctagatccctcagttcacagtagggtttgcactcctatgaggatctgatgctgcagctgatctgacgggaggcagagctcaggcagtaatgcgagcgatggggagcggctgtaagtacagatgaagccatcattcatggctcaagttggggacccctgtgctagagcacacacacagccattatatgtcccctcttgtggctgatttgtttactgtgggagcacagactacactgcagaggagagcagagctggggggaaagaaatggcggtggcatcactttgctgggaaaggctgtcttgttctggaggcaggataaaggcagcatgaatgcttctccagaagactttatcttacaagagcctgaatggatgactagctctccaaaagtaaagcactggaagggaagtgaggtgccaggagataatagttttgaagactagtcctgtgaaacggtgtttctttgtactccaatggcctattttaaatccttatcctatttgatactgtctgcagaatctgatgctagtgactccttcttcctttctgaagctcacttcctccttcgctcctgtggtaatagccttccttgccttctctgcaaagttttcaagttctcgtcttttgtgcttctcttcctctgcctgaactttcaatattgacgtttctggttaacaatctaagatcatatggtcactgtgtgatttatgttgtctactccttggtgtcacaaccacccaccatcatgccgtacagtcggtcccagccccttacgtgagctgggtttttattttggaacttcctaacaaacgtttctagatgaagcccacagagacccgatgctcaggaagtaaacctgtcaagaagccaacacattatttgctcctccaaatgttcttgtttctctgtgtttcatgtcttggttactggtactatcatccacccatgtggaaccatctagaagcctaagaatcaccttcagacaccaccttcccaccccacaaatactctacattttagcagtataagactgtagcagtttcttgaatgtaacatgacatttctcatttccataccttcatttatgttgtttattcttggaatgctcttccttcattttgatgcttcacacgctaatacacatccttcaagacccaattccaatgtgttttctattttggggcctttttgactctcctacgaagactaaattaactgttccttcatttgtattctctaaagggtttgtactattttctatacatttattaaagacccctgagctaagacaacctcctaagaaccctcattgtttcaaggaatataccatatggaaaagtagaaaatgagagtaaaagggaagctaatgtgagggtaggagggaaggtgaggcagaagaggtgaaaagaaagaacagagtaaagtccaagggtaggggagttgagtggccacgctcataaggagctttgccacccctcggtttcccgagcacctgccacgtgccaggcactatgggggctttagtgtagatgatttctccctcgtcttgctccttcatagcaagaggaaggaagcaccaaagtaaaaaacccgagaaaacctggagaaggtgcccaggttgtctcactggtatttagtgctcctagggtggctggaaaaagcatcccgcttcaagaggccaccatctgacacagagcacccaggtactctttcctgtaaagcagaagtccccaacccctgggctgtgaatcaatatgtgtctacagcctgtgaggaacagggctgcacaggaggtgagcagcaggtgagtgagcatgactgcccaagccccacctcctgtcagatcagaggtggcattcgattctcataggagtgggaaccctattgtgaactgcatgtgcaagagatctgggttgcatgctccttatgagaatctgatgcctaatatctgaggtggaacagtttcatcccgaagccatccccaccccgtgtcccatccatggacaaactgtcttccacaaaaccagcccctggtgccagaaaatttggggactgctgctgtaaagcatgcacagtgcacgaggcctggttgagctctgagacttggctgagcccttgcagcagaggtgactgatgaggacacagcatcaggtcgtctactgcttcctgaacttgtactgactttcaggtctttttaccttttatttatttatttatgagatggagtctcactctgttgcccaacctggattgcagtggtgcgatctcagctcactgcaatctccatctcccgggctcaagtgattctcctgcctcagcctcctgagtagctaggattgcagacaccccccaccacgcctggccaatttttgtatttttagtacagacggggtttcaccatgttgatcaagctgatctcgaactcctgacctcaagtgatccacctgcctcggcctcccaaagtgctgagattacaggcgtgagccactgtgcccagcctgagtttcaggtcttcaaacaaaagttcacctgctccagagttgttgaaatgtaatgcattttctggaaaacgtgtgtctcattcatctcttgttggcgtttctgaaaataccacaggttctggagacgctaccgcttcatgtctcctagcagcactggccatctacctgggcacaccagggctccgtgaaaatgtgttcctgggatgccagtgtttccaccctgggatccaggaggcctggctccaaaccccaagtctgcacccactacctgggagatgtaggggcatgacagctgctcagaggtctcagtgtcctcacatatattccaggaacagtaggctggttgggccaccggcgccaacatcctgtggtgatttcttcatcatgacagggtttcgtgtctgtgagatgcctggcgagaatctgtagcaggttgcatgagagctggcttggctctgatgctccacattcttctccgtggctcctttcctttcctttcctttcctttcctttcctttcctttcctttccttttccttttccttttccttttccttttccctttcctttcctttcctttttttctttcttccctttctttcccttcttttcttttcctttctttctttctttctttctttctttttctttctttctctctttctttctttcatttcttttcccttccttccttccttcctttcttccttccttccttccttccttccttccttcctttctttctctcagaattcagactttggttaattgtgacaaacctattaataatttctgctctattagtttcctcatacaatacagtgctttatctgtcagccagagtttccttggtgtgtaaccgtggctcttatccagtgtatctcataatatttattttctgaaataatcgagagcatatgcttgttaatgcttttattagttcacatttgagaatgggttgccagtttgcagtctagataatattatggtgtctctgcatctgcctgtcagctgcatctactacttgaatgtttggttatttctccagcctcccctcattaaccattccggttcctccttaggcagcgctcctcatggccactgagcatgaagccaaggtccctgcagtgatatcctacacagacaagggtgtaaatagcttagtttcatcaggctgttgaaaatgacaccattctccatgcaccaattctttttattttattttttattttttgagatggagtctcgctgtgtcccccaggttggagcacagtggcgcgatttcagctcactgcaagctccacctcctgggttcacgccattctcctgcctcagcctcccgagtagctgggactacaggcgcccaccaccacgcctggctaattttttgtatttttagtaaaaacggggtttcacctgtgcggtggctcacacctgtaatcccagcactttgcgaggcccagacaggcggatcacgaggtcaggagatctcccatgcaccatttccatcatatttttgttactctgagtggtaacagaacctgtagctgctctgttaacctggaaacgggcttgctttgtacaaaaaaagttacctgctttcagatggggccggtgttcatttaatttttctgatgacacaaacttgatgatgatgaagttccctacagagaaagtcacactagaaagactgataagttttcagacccttgaggttggccagaactctaaagaagaggtagatatggagagacttggtaaaaggaatcatcctgacgtagtgacagatgggatgtggaagatgaaggagagggtggaatcaaagacgaatcatgaaagcgacccctctcgtggcgttgaaaagcttctcagttgttggagaatctttcacattgtgagctgattagattgaaaaacacacatatatggggctgtgacctgaactatatctgacgaagtcagcaattgctttgtgtgtttgtgcacgtgttcatgtttgtgcatgtgttcatgtgtgtgtaaatgggcctggtgtttgtgactcagtaactttttctaagagaaaacacgcatcctcacccttgcaggggaggcaccagctgtcagtggtgaaagagagagaagggtcttcattcccctcgtcttccctctgctgtctccccagccctttacctcccgccttggccccttctcccgttcatcttcctctcctcctgctccagagaaggaagtaattaaacggtctgtcctgtgttggctttttttttttttttttttttttttttttttttactgcatatagccctttttttttaaaaaattatactttaatttttacagtatatgtgcacaacgtgcaggtttgttacatatgtatacatgtgttggctttttaaggatgtgagacttgtaaaaacaaaatactatgagtagaagtatggaacaaaatgacaagcctcatttaccttaaaataagaaatctcttggccaggcttggtggtggctcatgcctgtaatcccagcactttgggaggctgagacaggcagatcacttgagctcgcaaattcaagtccagcctgagcaacatggaaaagccccatctctaccaaaaatagaaaaatgagctgagcttagtgtcatctgcctgtagtcccagctacttgggaggctgaggtgggaagatcactgagcccatggaggtcaagactgcagtgtgccctgatggtgccacagcactccggtctgagtgacagggcaagaccctgtctcacaaacaaacaaacaaacacaaaagataaaaaaaaaatctctaggtcagaagcagatgctaaagagatccagtagtcaaaggtgaggggaaatgttagagtgtggtcagggttcatcctgcctgcatgacactgcccatcctgtgctggggatgctggtggctttgggcttgtgtttagatttgcagttggggtcatattccaggtccaatgcattttcccatccctgataagctcagcacgatatgtgacttagctctcagtttctctgaaggagatggccttgcagtttgaactccaggagctcctaggagccactgtggaaaagaggccggagcatgaacaaggagcatctaacttcagcctgacaggacagcagcttgcagtgcagtagttacaacaactccgtagaattaccaagcctgccttgtagtgattggggagggagagttggtccgttgtcacattgttgctgtgactagtccattagctgacctcgggggtgtttctctggctcgtcgaacacagggctgttcagctgttacaaagctcgtgtccaacctaacatcagtgtctctctctgatttccttttgcgagcttgagagctgcctgtgatacactgttggtggtgcttcatggaatttgtcctgtgtgcatgcgagatagttttaattctctttcacaaactattaatgagctcacgtctagggttgctagagtttaggaacaggaatcagatgaggaataatgaatttaaagatatagatagaggactctgagaaaaacagctgagttagtgagtcctatctgtaaagggtatggtttcattctttttttatggccgtgtagtattccatggtgtatatgtaccacattttctttatccagttcaccattggtgggcacctgggttgattccatgtttttgctattgtgagtagtgctgcaaggaacatatgcatacacgtatcttttggtagaattatttattttcctttggatatatacccagtagtgggattgctgggtcgaatggtatttcaactcttagttctttgagcctgctcttcacagtggctgggattatcatacactcccactgacagtgtgtgagctttgctctgtagccttgacagcatttgttgttatttgactttttaaaaaaaccatcgagttggtatctcattgtgcatgagacggtatgtcattgtggttttgatttgcatttccctgatgatgagtgatgttcagcattttttcatatgtttgttggctgcttgtatgtcttcttttgagacatgtctgttcatattctttgtccactttttaatgtggttatttgctttttgcttgtttattttaaattccttgtagattgtggatatcagaccttttgtgaaaaatggacatttttaaagctacaatattttggtttttagcatatccagagagctatgcaacctatatcatgacctaagtttagaatatttttatcacctcagaagagaaacttcaaacctattagcagttattccccgtctaccctgtcccctagctcctgaaaaccactattgttttagtttctatgaatttcctaccaccactccatcatactctgccacccaccaaactaatgccacttccattgctaagcccactaggacactccctaaaacttcaatgcctgaccctcatgcctccgtgtattcctaaatagccatcgctgtagtataaccaaaaacaactatcattccgcgcaactatcattccatataagtggaatcgtacatggtgtcatctttcatggctggcttctttcacacagcgtgatgttttcaaggttcattcatgtagtagcatgtcagtacttcattgctttttatgactgagccatcccattgggtgtatttaccacattttatttatctgttgatcaatggtggacattggggttctttccactttgtggctattatgagtagtgctactatgaatatttgtgtacgtgcttttgtgtggacatgtttttgtttctcttgggtagatatctaagagtggaattcctgagtcatgtggtaactccatgtttaacctgatgaactagagggagaaggttggtaccttgccacgttagaatgacacaaatctctcccaggtggtgagtatagctcccaagtggtgtagctcctgtcctggctaagattcagccattttttttttcttgaataaatactcctcagattcttgtaagcctttggttattttgcagagttctgaggagggtgattttgacagttttgttcgagctgctttaacagaagagcggctttttgggataaatttctcatcctattgcttatttttaaaattactttctttgcttttaagctttaatagtgttacttgaactttgcttctaacagatgcatcatatttcagagataaactcattaaatcacatcatattccccaaaactttgacagaaagttacctaagtcaggataccttggtgactggactttcccctgagattgttttccttcattgcacagtaagttcatattctactgctctccctctctttcttaaatttttctatacttttttgtgtcctctttattgagatacagtatgcattcattcacattctctaatttaagagtgcagtttaatgagctttgaaaaaatgtgtagtcatgtaagcacgattatgatacaaaacaatttcatccttaaaaacagcttccctctatctttttacagtcagtccattcctttacaccccagcccttggaaatcagtgctctgctttctaacactgtggttaagtccctttctagaatttcatataaatggaatcatggagtacctatcatttgggtctggcctccttctcagtacaataccttcaagattcatccgtgttgttgcatgcttatcagtagttcaattctttgttattattatgtagaatttcgttatatggacataactcagcgtgttgatccattcaacagttgatggacatttgggttgtttcctgttcttagctaatttgaataaagctatgaacactcatgcataggcaattctgtgaaaatttttattcttttagcaaaatatttagtagaattactggtcatatgataagtttatgtttaacgttattagaaactggcagattgtgacaaatgatgagtatctttttgtgtatttatttgccacctgtaacttcactgacaaaaggatcacccagctccttgaccagtttattattggacattgccttcctattattgaattgtaagatctctaaatatatactgtcaaataaatgtttttcagatagcttattccaatatgtggcttgctgtcatttctttaacaatcttaatagtgccttttgaagagccgagtcttttaattttcaccaagtctaatttatcaacttttttcttttgtgattttgactgtcatactctatttaagaaagttttgtctcagccaaggtcattaagctttattttgtttgtttctagaaattttgtagttttaatttgcacatttagctctgtaatacagttcatgttaaattttgtagatggtataaagtaaagatcaaggatcatttctgctggtatgtggatgtccagtttgttcatgttatgttgaaatggtgattgtctccatggagttgcttttacttgcacttttattgaaaatgaatttgctactgatggatgggtctgtttctggactctattctgttccattgatctatttgactacctttgcaacattattacagtcttgattactgtaacttttaaaaagacttaaaatcaggtcgtttaagtcttcagattttcttcctctttaaaattgttttggctattctagattacttatgtttcaatataaattttagaataagtttgacgatttctgcagaaaatccacttagaatattaagattgcattaactctatacatcaattttgggagaattggcatgttagtaacattaagtgtatttgcgtgtagatctctttatttaggtattttaaatttttaccaatatcacatattttttaaagtttatcactgagattatatttttaagattattcaaaatgtgttatgaatttttaacttactatttccaattgttagtatacagaaatattatttatttttgtaaattgactttttatcctacaaatttgctgaactgttttattgattttgtagtttttccatacatttcttaggattttctacatagctgttcattttatctgcaaatcaagccagttttacttactaatttctgatttttactgcttttatttccttttcctaccttgttacactggctaggactgccagtaaaatgatgactagaagtgtgagagattaaatctctgcctgggttctagatctaaggggaaaagtgttcagtattcatccattcagtatgttacttgtcagtttctcatagatatcatttggcagatatcttttggcaggttatgagagttcctgggttatggaaaatgccataaatttcctcttagcacttccttgcatgcgttctatgaattttgacgtgtgattatttagtgtttgttcatttcacactcacatttttacacagataagtattgagctaaaggtcccataggactgtgctgcaggtctctagagctcaggtcttctgtgaagcacctcctctccaacaccctgctccataacgtctagctttaccgaactcctggaactctgggctttgtgtcctcagttcattaggccaccaggtcttatctcaatctcctttcttaggctgtggtctggaagctttctctaggcagtgagctggggccctcgtaagctcaaatgtttgtttcctgtctattacagatgactctcttgtactgcctgttgtccaaagtctaaaacacatcattcgtgtatttttcctatgttcttattgtagaaaggagagtaaatctagtccctgttattcctttatgctgagaaacagaaatctgtaggtttactatcacactgatcttgtgtctctgatttcatgaaggaagcgtgcatgagagaaactcccagaggcagatgtgctctaggaggagtgaaggacagaaatggcaagccctaggtagcgcatgaggctgggaccaccattctggggttgatgtttctccatcacacattaggttgacctggggagtgtctaggaaaacactgatgctgttttgcctcacaaacactaagtcaaaatcccaggcaccagtgttctgtgaaagctatgcttgggaaactgacgtgaacctatttgtgtgaagcatggggctagctcctctaagctgattctgacctgtcttatgtgaggtcactgagctggctctgagatgcctaccaatattgaagtatttacagactgaagcaatttaggcagcatgctctagtacttccagtatcttcagacaagctgcaattcttctaaggagctgaggggcaggagggtttgatctcacttggtagtacagtggcagttgggaagtgcccgtggacatgtgctatgttcagaattgtcagaattgtggacagtcactccaggcactaatactgggaactgccaatcaaggcacatggtagcaacttagtaaattgcaactttttttttttttggaatgaatttgatcaggtaatttgttatctctgagcctcagtattgtattagtattgccatgtgtaaaatagtctacttctgttatcttccaggattttgtgaaactcacataaaatagaccacgtgaagacatttaggaatttatttaaaaagagggaggactataaatctacttagtatgttttatgtcttaataatttaatttagtctaaaagtgggttagatgtaacggtgcctttagaaattaggtcttgtgtaaataggcattgttttggtttgaattagttcatagaggaaagtaggtttactttaataaataattgaaaacatattaatacaagtcgcaaaaattttttagtgaaaagtgtggaaagaaaaaaaaactacaataaaacggatatggttttctgctttctcgttgttggtattttatttaagcattcattctttatataaggctcactctccttggcttttcttcctctctgaaataaacagacattagtcacatgcagaattaaacgctgctgcagaattttgtggtgtggcatgagacactcagagctgatggaagtctagaaaggttaagccgttgtccgacctgaatcaagcaattcttttcaaacattcagtaaaatgcggccaagtaggcataatctaaaatggactatgtggaggtcccgtgggcaagattggggaggaattcctgggcagtcttcatccattttctttttcctattatggtaagctaactcacagcttaagtcaatccatgaatccatctctagtcctgggtcaagcaacaggggtgggagtctggtggggaatccggcacttagagtaacgtgttcaccatcgctcgtgtgtgtgtgtgtgtgtgtgtgtgtgtgtgtgtgtgtgtgtgtctaatggtaggatgtttcagtctcttctcgtattgctccagagagagcgctgtggtctcacaagtcttctgaggattcttcctggtggttcagaacagagtgtggactacagaaactttaatgtataatgtgttcaggaaagagtacctgtaatattttgcactgttcatttttagtatagaagctgcaactcttgtcttaatctacatctggttttagaaggcaggagttcttagggaaaggctggtgtagcttcattttggcaattttaaaagttttacccgatgaacccttagccatccttgttagtcctgcagacaaccgtgaacataccacagacaaggtgctcagaagggggacttacctatgcaggtccaatcatctgcaaaggatcgggcacattggagcctgaccgtcttaaaaaagcctttctttatgagaatccgtgggctttttctgtccaaggcaaagcacaaagcacttgttgggcctatttaaggcactgcaggatggcatccttgatggggtgtttcaggtaagccacttgcaccttttgtagtaactttcttatagacagtgggctcattcagtgtgtggcagatgcccggcaagcatgcttcatcttgctctgcagtggcaactctctcgtttcccatgtggaattgtgaccatggagcttcgtattttcagagatttagttcctaatgaataaagtattttaaatgtacttatttatttgtgaccccaaaaaagaagggtttgggttagatgatctctttcagctttcagagcctgcagtccctttcctgattccgaatcataaatgtatgggaatgtgtcaatgtgcaagagaaagaggggaacagaaaaagtcaaatacaaacacaagagtattccagttaacttaagcgagaaaatcttccacaattcctctttcttttggattctctcctgttgtctccaaggctcactgactccaacacagggccctgagggtcggttgcaaagtgcttgaacattctgtcctttgtttcacatctagtctcatttcagggtccgtttgttgacacttgaagtcaagcgctgtgtcatcagagagactctggtgcaaggcagtcagctgtttactttgctgcacaatctctgtgcccagttcagccagagagagcagccctgcatgcagcaaaccagaaccaagcctgcagcaggactcaactaagttgtcactctggagtgtttttctggctggaaatgaagctaatccttcctaatgcgctggcttcttcgaccatgtccaagcgagggctcacatttggctaaggcttcgaatcctgtttcagggaatccaattcaattaattcaatgttcctctttacttagcaaatactaaatacctactacgtaccagccagagcagtaggcactggagtacccatgagacgtaaatctaggtacatagtgggaatcttaaatttgctaggactggggaattcgggtgtatagccaaacaaagaaaatgtagtggaagaaatatcaaatgcaaaaaaagcaagaattcttagtttaaaaaaaaaaaattatttcacttatgaaaggagtcttctgtgaaaccacccctaggtgtaagccctggggatagatcgttagaaacaggaccccccacccacccccacagagtacctgggaacttaagcctacaaagattttctagactctctattagagaaattttaccaaaacagttatgtttcaggaaagtggggatcattttacccagtggccttgcaagtttcacagcaagtctccttgttatgggtctacagggaattaaggcaacttgaactaagagagaaaactatggtatattttctaaaaaaaaaaaagaaaatactgcaatgagagttctattttttttttttacttggtagagtaagtcatacctaaaatttccctgtaagaccttggtcaaaataagaatgttattactttggcttaatatcaaaatggtaaaacatgaactggaagtcaagataatagttttctttacatcttaattgcaaatccttcaagaaaaaaggaaaatatgacaaaagcaatatagcatagacattgaatagagactttgaagtcaaaaagcttgaaatcaaataatggctctagccgtcactcaatgtgaggtcggaggcaacttatgaaacctctcttagcctcagtctttccatgtgtaggatggggatgataatatctatttcacatggttattattacaattaaatgagtggctaattgaaaagctctttaacaagtgcctggcatgtagaaaatgctcagtaaatttcatttactatcattcttgttgctactgttactgttattattacctgcagtgtgtgaggtcttaggctgtgcttggacttggacatgaactgggaagggtgaaggggagggtgaactgcaaacctgagtaagggtgaaggagagggtgtactgcaaacctgtaataaaagaagtctgtattgaaagaaaaagaagccaggatccccagagatacaggggagagtgtagaatgtgagggaaccagcaaacccagtgttctctagtcttaaacactgaaacgtctgagacagctttatacatctccttgggcgcatttctctaacagacaacagtgtggaaatctgatccagctaacaacagaaacacgaagaaccaactgcataccactccatcaagagccaaccctggtttaaagtaaagcttcctgtggtgtttcagtcttattatccctccagggatccagaagtcatcatgaagatatttcgctaaaactgcactcgtacgtttaaacactgataatggaaaaatgtattttgccaaaaacagtaagaactgcaacttctattgaaacatactgagaaatagtgttatagtgaaagtcaaagatctgatgttgaatcaggttgggagggcaagaaatgattttcatgaagaaggaagaaaatgaatattttcaaaagctcacctgcctggaagtcacaatgaagcattaaggaacatctgacataaaaggagggagtgtaattcatcaagaggatgcccatggggacttgattgctggactttatttctaagtcaggggaggcatgatcctaagcattctgaagagatggaagggacatcggggctgccactgggcccctccctcacacctcatgctccaccaggagagctcagccttgccacgcggctctgtggcctgggacctcagggtcggggtgagccgtggtcctgctcaggggatagcaccctctgctctgctgtgcacggtagccccacttttcattctgcacacttcttctaagctgcaggagctcctggctctttttcatgtcaccaaagagccttaaatacagaaatcttcatgttttctttcttttttttctctttaggagtctctagactcctcttggcccaaaggttaacatggtaggtggcatttgcattaagtaggtaccaataggggtgtgtgtgtgtgtgtgtgtgtgttgacctttgctttgatcagcttttattacaaaatttgaccatgactacgtttgtgtgcaagagatgccgctggaagtatagtcccaggctgggaagctgctacctagcagcaaagttacactagggaagaggaggtgcacagctgtggctgacagcagcggcctttgccacaatcagtactgggcttcagtggtctttctccctctattatatcacatttattataacagctttatgtgcatgtgtctctaggtcaccagctccttatgagaagtacccgagctgtttatctttctttctccaggccccagcctcattctttctttttgtcctgattttactttttttattatactttaagttctgggatacatgttgcagaatgtgcagtttgttatgtaggtatacatgtgccatggtggtttgcttcacccatcaacccgtcatctacattaggtatttctcctaatgctatccctccccttgtcccccacccccgacagaccccagtgtgtgatgttcccctcactgtgcccatttgttctcattgttcaactcccacctatgagtgagaacacatggtgtttggttttctgttcctgtttgtttgctgagaatgatggtttccagcttcatccatgtccctgaaaaggacacgaactcattctttttatggctgcatagtattccatggtgtatatgtgccacattttctttatccagtctgtcattgatgggcatttgggttggttccaagtctttgctattgtgaatagtgccacaataaatatacgtgtgcatgtgtctttataatggaatgatttataatcctttgggtatatacccagtaatgggattgctgggtcaagtgatatttctagttctagatccttaaggaaccaccacactgtcttccacaatggttgaactaatttatactcccaccaacagtgtaaaagcgttcttatttccccacatcctctccagcatctgttgtttcctgactttttaatgatcgccattttaactggtgtgagatggtatctcattgtggttttgatttgtatttctctaatgaccagtgatggtgagatttttttcatatgtttgttggctgcataaatgtcttcgtttgaaaagtgtctgttcatatcctttgcccactttttgatggggttgtttttttcttgtaaatttgtttaggttccttgtagattctggatattagccctttgtcagatggatagattgcaaaaattttctccctgttcactctgatggtagttgttttttgttttgctttgttttgtttttgctgtgcagaagctctttaattagatcccatttgtcaattttggcttttgttgcaattgcttttggcgttttagtcaggaagactttgcccatgactatgtcatgaatggtattgcctaggttttcttctagggtttttatggttttaggtcttacatttaaatctttatcttaagttaatttttgtataaagtgtaaggaaaacgtccagtttcagttttctgcatatggctagacagttttcccaacaccatttattaaataggtaatcgtttccccattgcttgtttttgttaggtttgtcaaagatcagatggttgtagttgtgcagtgttacttctgaggcctctgttctgcttcattggttgatatatctgttttggtaacagtaccgtgctgttttggttactgtagccttatagtttgaagtcaggtaccatgatgcctccagctttattctttttgcttaggattgtcttggctatatgggctcttttttcggttccatatgaaatttaaagtagttttttctaattctgtgaagaaagtcagtggtagcttgatggggatggcattgaatctataaattactttgggcagtatggccattttcacaatattgattcttcttatccatgactatggaatgtttttccatttgtttgtgtcctctcttatttccttgagaagtggtttgtagttctccttgaagaggtccttcacaccccttgtcagttggattcctaggtattttattctctttgaagcaattgtgaatgggagttcactcatgatttggctctctgtttgtctattattggtgtataggaatgcttgtgcatttttgcacattgatttttgtatcctgagactttgctgaagttgcttatcagcttaaggagtttttgggctgaggcaatgggattttctaaatatacagtcatgtcatctgcaaacagataatttgacttcctctcttcctaattgaatatgctttatttctttctcttgcctgattgccctggcaagaactcccaatactatgttgaataggagtggtgagagagggcatccttgtcttgtgccagttttcaaagggaatgtttccagcttttgcccattcagtgtgatattggctgtgggtttgtcataaatagctcttattattttgagatacgtcccatcaatacctagtttattgagtgtttttagcatgagggggtgttgaattttatcaaaggccttttctgcatctattgagataatcatgtggtttttgtcactgattctgtttatgtgatgtattatgtttattgatttgcatgtgttgaaccacccttacatcccagagttgaagccgagttgatcatggtggataagctttttgatctgctgctgtattcagtttgccagtattttattgaggatttttgcatcaatgttcatcagggatattggcctgaaattttcttttttagttgtgtctctgctaggttttggtatcaggatgatgctggcctcaaaaatgagttagggaggattccctctttttctattgtttggaatagttttagaaggaatggtaccagctcctctttgtacctctggtagaatttggctgtgaatccgtctggtcctgggcttttttttggttggtaggctattaattactgtatcaatttccgaacttgttattagtctattcagggatttgacttcttcgtggtttagtcttgggagggtgtatgtgtccaggaatttatccatttcttccagattttctagtttatttgcatagaggtgtttataatattctctgatggtagtgtgtattttgtgtgggatcagtgttgatatcccctttatcattttctattgtgtctatttgattcttttttcttttcttctttattagtctggttagtggtctatctattttgttaatcttttaaaaaaaaccagctcctggattcattgatttttgaagggttttttgtgtgtctatctccttcagttctgctctgatcttaattatttactgtcttctgctagcttttgaatgtatttgctcttgcttttctagttcttttgattgtgaagttagggtgtcaaccttagacctttcttgctttctcatgtgggtgtttagtgccataaatgtccgtctaaatactgctttagctttgtcccagggattctggtacattgtgcctttgttctcattggtttcaaagaacttacttatttctgccttaatttcattatttacccagtagtcattcaggagcaggttgttcagtttccatgtagttgtgcagttttgagtgagtgtcttaatcctgagttctaatttgattgtgccgtggtctgagagactgttcgctttaatttccgttcttttgcatttgctgaggagcgttttactccaattatgtggtcaattttagaataagtgctatgtagtgctgagaagaatgtatattctgttgatttggggtggagagttctgtagatgcctattaagtccacttggtccagagctgagttcaagtcctgaatatccttgttaattttatgtctccttcatctgtctaatattgacagtgagatgttgaagtatcccactattattgtgtgggagtctaagtctctttgtagttctctaagaacttgctttatgaatctgggtgctcctgtattgggtgcatacatatttaggatagttagctcttcttgttgcattgatccctttaccattatgtaatgcccttccttgtcttttttgacttttattggtttaaagtctgttttatcagagactactgcaagccctgctttttttactttctatttacttggttaattttcctccatccctttattttaagcctatgtgtgtctctgcatgtgaagtgggtctcctgaatacagcataccagtgggtcttgactctttatccaatttgccagtttgtatcttttaattggggcatttagtgcatttacatttaaggttaatactgttatgtgtgaatttgatcctgttgttatgatggtagctggttactttgctcattagttgatgcagtttcttcatagtgtcgatggtctttacattttggtatgtttttgcagtggctgttactagttttccctttccatatttagtgcttccttgaggagctcttttagggaaggcctggtggtgacaaaatctctcagcatttgcttgtctgtaaaggattttatttctcctttgcttacaaagcttagtttggcaggatatgaaattctgggttgaatttttttttttttaagaatgttgactattggcccccactctcttctggcttgtagggtttctgcagagagatccgctgttagtctgatgggctttcctttgtaggtaacctgacctttctctctggctgcccttaacattttttccttcatttcaaccttggtgaatctgacgattatgtatcttggggttgcccttcttgaggagtatctttgtggtgttctctgtatttcctgaatttgaatgttggcctgccttgctaggttggggaagttcttctggataatatcctgaagtgtgttttccaacttggttccattcttcctgtcactttcaggtacaccaatcaaacgtatgtttggtctttccacatagtcccatatttcttggaggttttgttcgtttcttttcattcttttttctctaatcttgtcttcattctttatttcattaagttgatcttcaatctctgataccccttcttctgcttgattgcttcagctattgatacttgtatatgcttcacaaagttcttgtgctgtgtttttcagctccatcaggtcatttatgttcttctctaaactggttattctagttagcagttcctataactttttatcaaagttcttagcttccttgcattgggttagaacatgctcctttagctcagaggattttgttattatccaccttctgaagcctactgtcaatttgtcaaactcattctccatccagttttgttcccttgctggtgaggagttgtgatcctttggaggagaagaggaattccggtttttggaattttcagccttttcgcgctggtttttcctcctcttcatggatttctctacctttggtatttgatgttggtgaccttcagttggggtttttgcgttgtcgtcctttttgtttatgtcgatgctattcctttctgtttgttagtttttcttctaacagtcagtcacctcttctgcaggtctgctggagtttgctggaggtccactccagaccctgtttgcctgggtatcaccagtgaaggctgcagaacagcaaagattgctgcctgcttcttcttctggaagcttggtcccagaggggcacccaccagatgccagtcagagctctcctgtatgaggtgtctatcgacctctgctgggaggtgtctccccgtcaggaggtacgggggtgagggacccacttgatgaggcagtctgtcccttagcagagcttgagcgctgtgctgggagatccactgctgtcttcagagccagcaggcaggaacgtttaattctgctgaagctgcgcccacagccgccccttcccaaaggtgctgtgtctcagggagatgggagttttatctatatgcccctgactggggctgctgcctttctttcagagatgccctgcccagagagaaggaatctagagaggcagtctggctgcagtggcttggccgtgctgccatgggctccgcccagtctgagcttccctgtggctttgtttacactgtgaggggaaaaccacgtactcaagcctcagtaatggcgatcacccctcccctgaccaagcttgagcatcccaggtcaacttcagacggctgtgctggcagccagaactttaagccagtagatcttagcttattgggctccatggagatgggctccgctgagcaagaccacttggctccctggcctcagcctcctttccaggtgagtgaacagttctgtctcactggtgttccaggaagcactggggtatgataaaaaactcctccagctagcttggtgtctgcccaaatggccacccagttttgtgcttgaaagccagggacctggtgatataggcacccaagggaatctcctggtctgtgggttgtgaagaccgtgggaaaagcctagtattgggctggatagcattgtccctcacggcacagtccctcatggcttcccttggccaggggagggagttccgtgaccccttgtgcttcctgagtgaggtgatgccccaccctgcttctgctcaccctccatgggctgcacccactgtctaaccagtcccagtgagacggactgtgtacctcagttggaaatgcagaaatcacccaccttctgcattggtctcgctgggagctgcagatcggagctgttcctatttggccattttggccaggaatcctccttacagatgctgtttattctaacaaccattctgtccataacacacacacacacacacacacacacacacacacacacacacacacacacgtgtcacaagtgaaattttgggcaagtcattagatgtctttgaatatcactcacacagcaaatttgtgggtatcccaggattagaaacaatttatctcaattgttaggtcagagctatttctccttatgtctgtgatttctatctaatgtgtatattaatataagaatttcagaaattatgcagtaatttaaaagttcaagaaacctttattgcaaacacctccttctgcatttcacaggagggcctaaagaaaaactttttcatagaaacatgtacacaagacaatattaccagaaatcaacccccaaaatgaaggcatcagggggcacgaagaagagacttaacaaactttttttcttcccttgcaaattctggtatcctaagaagcagtctgaatgatttgtgcatgaaactgccttggagcaggtgcaacttcagggggaattctcttatttttattgcataaaaaatgaatcctatggaaatacagactcctgttctgctgagttttgcattcgcatagctgaattaggagagggagatccagacagtacagtgtactgataccatttgaaatatccccacttgttcttcatgaattcccccatgaggttgtcatcatttaattcaatttaatctttaaaattcaaactcttttgaaactttttatatgtggagtgctctgatctcatttttggcttctatgacacttttcccttaaaagcaaagctgtgatctgtggcgaggaagtttgagtggtgcatcttccagtctcatctctgccatttgttccagtgtctaggaggaaagaatctttgcactatgcatattcagtgcactagggataaagtggccaatgtgtcttcattccccaagctagaatggtccttcatttatcggccagcctttgctgaacacacaggtcctgccattcactgtacaagggaaagatagagattaagatccaggcaggtccctgctcgcagtgctgactgagtactgtacctatttgcccatgtgatgtgtctttctattttccaatgagagtggaggtccatgttttaagactactttgcctcccattgactgaggattgggattagatctttgattgggctagagggagaggtgagacactttgaaggggtacagaaataatctgtggagggagaggaatcaagagggactggacaaagttgtgtctttatcttctggtccccagattcaccactcccctaagagcaacagcactagctcacagctttagcatgacatcctctgtagctttactcacagtgggaccagttctgtcacagtaggaagaaattctgtcaaggactaatgtcattgctccccgggtggcccaaggcatccccagctgatcatgtgaccagccagcctcccattcttccaggtcagagagaaatgatctacttttttatcttggtgtggtggatgggactaaggaaagaaagagttggggtttgtcatattatttctttactttgtactcagtagattatattgacaggcattgagtaaatccagtggaaacatgaactctccatactgtagtagacattgaataatttgagcagaataacagagagaaaaggaaaatgactaaataacattttaggaaataagctacatttcctagacgtgggatttggcaatttgggatggatggagaaatgaactttgtgtatctctctgaaacaggtgaaattgacattctggaacaaaaatctaactatgaaaaagaaaactctttatttcaaatctatacttgggcaacagtttggggccaggaggaataaaagaccttaacaggtcctctgtagccctctctgacttctaggcgtctgagtaatcacagacacccacacattgttttaaaaccctccagagagagaaagggagaaaaaatgtctttgataagatcaggtgcgttcagggtcgtatggctgtagacagaaaaatgtttttgtttccactggttacacattctgatgtccgacctacatcccttctgatgaaattcaaaccaaacccttttctttcccagtccccattggaaacagaaaatagatatgcatttttcacactttaaagaactcatcatgtaaaaaaattgctttttaacacatttcatgccatcatgtcttccttggaaattttcagtgcctttttttctatttgtctaagtagagaagctatctttctattttttttatggcttcttctgaactcctaccgagacctgttcatctcacatcttcaggccccaaattggatacacaatttttaattaagatgtgatccagcgaagtatttgcttagatcttacagatctggaaaaaaatgcccttaagaaaagactaggcaaatagaaataatataatctccttgcctcagtccaaacttgaaggactcattagaggatgcatgcaagtagggaccagaggaccatgaaaatcctgctgggattgagcgtgatttctgctgagatcactgagatgccacaacattgaatgctgaaagttttagcaggaatcgttggtgaacttttcctttggaattccgcaagtgcttcttgttacaggcatagacaaatgtatactaaaaattacatgtataatttaaatttcagcaagaaatactgttgacttcttatgaggaaaaccaggcaagtgatttgtaaactcttgaagcaagaaatgttgatgtcttctccatctctttatcctgtagagcacgttgcactgagatggccccagaagtagatactgagaaagttctagttgaatcatttaatttgaatgaagctgtgagataaaaggaaaaaaaagaggctacttataaaataaatttatagtatggtcacattatccagagtaaggttagttcggtttggtttgaattgtttcatttttagccaggcacagactgctcagaaagtaagcatttaaaaatttgtcgagatgttatttattatttggtaaaagttgcaatgcaccaagatgtaagattttacacccctgagttttatggcatcacccttgctaatttattcatgattaaaccaaagaactctcaatgaggagaagtagattgcaatataaattggtgtcattgtttgtaaatgtgctccactaagcatatatactgctccactaagacagcttctagtaccatgcctggggcttcaatgcaatttgcttacgttgaatcactggctcccagactccccttgtgaactgaacaggcttagaaaatcattctaaagaatgcatggtttgtgtagttgtagaacgaaacttctcttggaagcttattccccctcaccagggaaggagttagtgggagattctcaatctggtctgcagatgagtgccttctaggtaattcacacatataatttacagaagtgggaagaaatgaattcaaaccatttttttttttccctcagaaaactaaatgtcaatctcattccatttccgttggacggggaaattgacgtaggagcagcgtgaggtagagtggcatgctgaccataactagggtcagtcaccatcggaggacccagcagagagctgtggggtgctgcagctggggaggactttctccatctgtttccccttggtaccattgatttgttgtctgatttaaatatagagttcagtatgcaggtgtgtaagtgcagcataaataaaatggcatcctccttcacagccaaggggccttcgtctgggaaactgatataatttatgagagcgaggcagcagcataaatacgtggggtgctttgtcaccggccagtatggaattggtcagcttggaggaggggaaacagagtcagggggaagacagcatgccaggaggagctaaattggggcaccaggacctgaaccctggaagccagtccctaaacaaccagagctgctcagcaactgctctctaattaccctttgtccctggagaattccagaggggatgggattgcctcagtgaacttaatcttagatgggtggctgtcctccttctttttttcccttgacggaggagggagggagggcgtcgagggtgatgcatcaaactgagggtgacaagaagctggcgccttttgctccacttcccagccaggagggctgacagtgctggagtggaccagtccgcggagctccgggggtctgaatgctccaggggtgtgtggatggcaatggccaggatggccctcctggttgcgacccatcagaaagtggataccactgtcctctggtttgcctgctgtgctggtaaggtgtggtgacgtgtgtgtgcctgtgtgtgtgcaaagggcaaagagatggacagtgttaccattattcatttggaattagaattgtggaggcttgcacatttgtttgtcttccaagttctggcctcacccacccttttttgagggagagaggggccaggaaggaggccgttcccagccccatgagtcaaggagggcatcgggggatgctcccactgaggaagctcagagcggggcccggagaaaggggtgctccaagcggtgcttcctggtcgatggcacgtcggggtgggcaggctggagttgaagagcttctcagcgtggataggaaatcatggaaatgaggaatgatctagcctccagcagtgagtcggaggaataaatgaatcccggaaatgcagtttctgtgaactccagattgctatggagattgcattgctttcccaagacttaaaaaacgaagagtcagcgaaagctgggagagcggtgatgtatggaagtcaggcgggccagcgcgccgggagtggtgggaagggggcttcgcaggtcattacacggggatttctccgcgcagaaaaagggattagcgttttcacctggtggggatttcatgagcttttccctggcctgctcttcccctgccctttcccagagagcccagcttcagggacagcgcccgcgaggtgctgctggggtggcggggcttgtgggcggaggagggcggctctctggtgtgcagcaccgggtgtgagtgtgggtgagcgtgtgcgggagagggtgtgagtgtgagtgggtgggtgggtgtgaaaatgggagaaagtgtgagcgtgtcacagtgtgtgtcactgagtgggcgagtgagaaagtgggtgaatgtgtgcgtgactgtgcaagtgtgtgagtgtggggagtaagatttgtgtgagtgtgagtgtgcaagtgtgtgagtgtgggggagtgagtatggggaggagtgagagttgtgtgattgtgtgtacacacacgtgtgcacacagggcgggccgcgcttggcatttgaggaggggctcggaggtcctcctgggctggccgctgtcctgggagcagggcaccagggcaccctgcgagttttcaccttgccaaggtatgccagaagccggactccagcttccttgccaacgtgtgcgggaagcaggaccccagctgcggtccagggaggaaaaggggggtgctcacagctggggcgagtccctggagcccacaggcagtgacttgccccagaatgagcttgagagagtctggggatggagaacactggggatgcttggtgtggtgcagaggtaggaggatgtggatgcctgtgaggtactggtgcgaggtttgccacgtgttatccctgcatgagagagcgtggaccactgttttaggccaggatagggacagcatgtccaattacacagggctctgcccacctgcaagatgcaaggaggccctgtctccaatgtcccctgacctgacagtcctgccacctgccagcctcgcagtggccagccccgcccccagcaagccccacccctaagagccacacccccaacagctcacccccctgccagccttgccctcagtcctgccccctgccggccttgcctctgccagccagagccagtcccccagcaagccccgccccctgctggctctggcccttctaagccccaccctcaggcagtcccgccccctgccagccccaccactgatcatccccgccctcagacagttttgccccttgccagctggaggtgggcctcctccagccagagtgaatctcttagtaagccccaccctcttccagccccaccctcaggcagccccacctgcttccagccttgctgaacagtcccgcccctgccacccacatgggttcctgggtcttgcccctgactaccagggtgaccccaatgcctccgagacatccttctgccctagaacagccaggagagcagagagaacaatttaaatgctcagaaagacaactctttcttactgtttttgctttgcccagggaattgcaatcagtttcaatacacagttaataaaatgagaggcattcagcgtggatgtgggtgtcaagggagagggctcaggcttgcttttgccttttagtaccagttcctattgtttggaaaacacgaggtggcttccgagaacaggtcttggccctcgcctgccctggagccccctgtccaagggccgccgtgcctcacaggcaggtgcattgctcttgttttaatggtggccttcatggcagtgggacccctccctccatgactgtccccaggtattgcctatggtgttatagtgtgggggcctcagggaagggtaggtgacctgtccacatttaacataattgtaaagctcattgaagaaaagaggacgaaggagtgacgtccaagtttattgagctttaggaagagaacggccagatttcgttttgagattttctcttatttgctggaagtctgttcaaatcatatgtctcttctgggttattaaacggtcaaggttgtttctggatccccacaaaaatgtgaggatacaaagtccccttgggatgtgcagtggtacccatagtcctcgtggttagaggataaaggggtccctagaatgatggagtaataagggcaaggtgtttggaagcaaatgccgagaagaaatgctcccttatgccgtaaaggccaggagactgtggtcgtcaggctgagtggatggatgggaaaggaggaagtaaagagcacacaccggcttttggaagcagatagctcatagcatttgaagagggcattgccatgactctggcctgcctctctcattggggaatcaaatattaaaaaaaaaatacttatatatcttttagagtgatcttctttggtaatttttagtatataaaaaagaaaaatagggaagaaaccttcaagtttctacttacatttcctgaattaaatagtttacatccatagaagaaaataaatattcatgcaaagctatacaaattcctttgtaggtttttagtaactattctaacagaaatgtatttgtagctaaaaaatgaagtgttaagcatgttttaaaaacggagcattgattttctacagcagggatatttagagtcttctttcccctggttacactcatgtgcatttgcttaaatccagtggcctctggctgcacctgcctttgcatcatgactttgtccaatcctgcatgtgttaatttagggcccaagggaccagtctggagcacgcagccatcctgagtaattcacagtccattagacagcggtctgtggggtatgtgctgagtccacacactgatgttccaggaggttcttgcaacttccccaccttgcagctgcctctccagcaccttactctcagtccttccccacaactactctccatctttaacttattacactccctgtcttagtccctttgtgttgctataataaaatacctgagtctggataatttataaagcacagaaatttgttttctctcagtcctggggtctggaaagtctgaggtcgaagtgctggcatctggcaagggccatcttgctgtgtcctccatggcagaaggtggaagagaacgaaccttctcctgcaaccccatttttttaatacattaaatgcatttataagggtggagcctcatgatttgaacacctcccaaaaggccccaccccccaaacactgttgcattggggattaagtttccagcacataaattttggggggcacattcagaccatagtacctcccaaatctataaggccacctctactttgctctcagctctatctgttcatttgcaattgtcttttaaaccccacttaaatgtcctatcacattttatcaacaataacttacttcactgggcttccttacacacactagttcctattcctgacttctgatttttattaatatccctgttcttctagttatccatctttgacacttataatatctctttcatttactacatatagtaaagtgaccacattttgacaattctttctccagtgtaagtgtggtgtcctataactaatgcccttttcttcctatagccatcacttgcatcctccatgattggaacagtcccctggtgtgccccacacctgctgttctcctctccagcatctaatccgtcctacccactgccatcagatcactatggagagcccaggcctaatcatgtcaattccaggctatcagatgttcattgtcagtttaatcacagaattggctgaagtcctttatgctctaattattccatcatcctcaccctcttctcctacatgcaattgacactatgactaaatggggtacttgctcttcctccaaaaaagctctaaacgtttttgtttccttgcttctgtaaggcagttcctcaccctataaggggcccattctgtccctgaaattctcatccctcatatttatctcttgaaatactgtccattatttaaaatacaggtcccataccttctttttcacaagattttccaattttcttaacttgaagtcatagctctctccccctacctcctccttccccggtatacttggtaattctatattcacattattcacacacatgcatccaaacatttttcttatccttctactaaatatgaaatatcataagtagaagccactcctgcttcacggcagcagtctcctacataaccacagagtttagacttcactaaaatgtaagctttgtttttgtcaaggttgtatctgaatcagtgtctatatcagggcctgtaacctagcaggggtttcaagagtgctgatgcaatgaacagatgaatgaactcttgtgaagcaatagatctagcacccagattgatcccgtcttcttacaaacacatctttaggctgtccccctgtgtcttcttcaaagttgacactgatattcgtttaaattttatttcacctgaataaaaaaatatagtgtgagaatgatctgctgagagcccagctctccttaaaaaactctgcctcaaagatactttaaattatattcttgatgaaatttgtattcttcgtgatgtatcaacctcggcagcaaatgacaacaaaccacagctggttactgtttgaacccaaggttgtaaaccaaagagtgtgtgtgcatttctccccaccctaccccatacaacctacttcatcctcatgcatgtgtagataacaggtcaaccaaggctagaaatcataatgggtgtgagttctggttccagagttatatcacctcaatgatcttattcatttcattcctctacccttgcttgagtaaagctaatcattttctcatcttccccagatctctttggggttctaaaccaagctgaaaagtagaccacagttaatacgccctctttcccagccacccagtacatctcctgtctttagccagggaagcacctgtatgccccaattctggccaatcttggctaaggtgccaactctaacgattctagaagctgttggttaagtgtgttgcctgatcagggatacttccttacaatgagggagttatgaagaagctattggatcaataagctaatattatagaattacactatccagtactagatctggaagcaaccttataggtacatattctaactccttttataagtgaattaagtgacctctctggttgagtgatataagatctagtccaggctgtgccactaactcccaattcatgtgtatttcaccataccatctgcctttcctctagagtctccaaagaacaaagctacaatgagggaataaaaaagtagaattcacaatgttaagaaggcagttctctcaaaccataccacgtaacagcaactcctctgcctagccatggtgccaaccccatcaattttcaataaaacttcacctgtaatattcaaggagtagtggagtacgtgataatgcactagatttaaagttacccaagggctaatttttaaaaaatcatttttcatatccaatattaaattggttgttagttcttttctatatgtctgtgataacctttgtgccctggttagcagggtctagaaagagccatccatctcaacaacagtggatttagacttgcaggaaacatacagcttgagtgatttggctgtatctttaatgattcctgaacatctgccagaaagaagttgctcatttcaagtaagtcagtgatttaaacttatttttctgttttgtttctttctattaaaagtttctcctaaaattttaatttcatgagaaattctgattagttgggaagtaattttttttagttataatacaagtcaaaattaatattgacttaaggtataaattaagtttactcttgtagtgcctatgaaagactaaaattatgctgttcataaaatgtccctacagataagtttcacttaactggttttagaagatgcttttgggcctttttatttgccctaagcagacatttggactcccttaggtgaaatatgctccagcattagactgctttatttactttgagtttgtcttctcaatatgtgatttttagaaacttcaaaagtacaatgtcttttacatttataagtaaataattgagggaccagcctgcctggagcaaaggaatcagaaaacaagaaatctcagaatgactggtgacatggagtctgtgcttcactgcagttgctagaagtaaaccacagattgagctctgagcttcctaatagccatggcaaggagggaaagccattgaggtgctattcacagtagccactgataaaaacaaagcagccattcactagccatttcctgctagtgaaacataaggacagtttatcccatgagttcttttaagaaggaatgaagggctgggcgcggtggcttatgcctgtaatcccagcactttgggaggccgaggcgggtggatcacaaggtcaggaggtcgagaccatcctggctaacacggtgaaaccccgtctctactaaaaatacaaaaaattagccaggggtggtggcggatgcctgtagtctcagctacttggagagaggctgaggcaggagaatggcgtgaacccaggaggcagagcttgcagtaagcggagatagcaccactgcagtatggcccaggtgaaagagtgagactccgtctcaaaaaaaaaaaaaaaaaaaagaatgaagaaggcagatgcaatgtgacagagatttactagatgatgtgctcgataacacccttcaactagaaaaaaaaattagcttctcttagaatgtgctatcggcatatattggcatacagtaattaagtgtaattgagaaaaggtaattctgagagggaataaaagcaccagatgggagatacggcattcactcttacctaagtcctacctaccttcaagacctggatgaaacatcacttcctccaaggagtcgttgacagacttaggccacagtgatcattgctgcttccaaacatctatggcatttgttgaccaagctatttatgttatactataaggaagcgttgacaaaaacgtggcagttttggtatctgggcaacattccgcaggggctaggattgtgtcatttattgtagtaaatccaatgtctcattcatttcctgtcacccagtaggccctcaggtttgttgccatggatgagttaacagatggcactgactcttggtggcactggagactgcagccatcagatgatgtttcaagagacactccactgtgatgacacatcctgaagacagggaaactaatgtcctttgagaagtacaaatgtctatttttatttcacgtagtattggcttgaaaagatacaaattcacttaggatgaaataaaagtgttctgtatttgaactttatttcaaattattatttcttggaggtttttattaggcaaccagttcctcctgtcttagaaagatgtagggacggagaagttctaaaaattctgggcctatccttcaaggttcaatctcatagtttcttcctcaggaaaacctcctctggccatcctagcagatagacatggcacttccatgtctgtccaattcccccaaaacatgacctaaggctcatctggaataagcaatcttcttctgtgtaaatattttataactatagcctattataaactatttgtttagaaaaaagactggaaaagtacacaccagaatgtagggtgtgtattttcccttcaaactcatttacctttgcagccctcttgaataatgtccttccaagccttttgaataacttttatgttgttgaatatttaaatcgtctccaatagtggtaatttttacagtctacaaacaacaaaaggtaattcaatgtcaagaacaattaataagatagatattcagagtggttgatatggtgagatgaggtttggtttccaaaaaatggttgttctaaaaggaaaccaatcatgtctatgtatgttatatgaatgttgagctctgtttggagttacccccatcatgaaggtgccctcaaccatagcagtgtcactaaaataaatgacaaggcaattttttggaaggtaatattgtctctgaattaaaaaaatggaaaatctttatgcctctctctctctctctctctccatccaatgacactaatgactacttcaggatgtctgaatattgtacttgcttatatatgttcactgcaaccaccatggcaatgaaacatgacaggtcctatagtggaaatcatggcgtggtcctccaaggttaaattggagggaaaccccaccatgaaatgcagtggctagatgctagatcttcactccactccccactcaccagcactgcttctggctttgggattgagcttccttctgggtgaagctcagaagagctcaaacttttctgagccaaggtcaagctgggaaccttgttacgctattttatttttaaatattcacttcccattatgtctgagtcttcagccacatcttgtttatctggtgaacgagtaaataacacacagtttctatgtcagtttcattcatcccatgttttattgagcacctgctgtaagccaggcattcacctggtgatcacttaaggcccatctccttgcttccagcttgcttccctataatagaggatttttttattctctttgagtatgagtgcacagcacacacacacacacacacacacctgttttgtattcaaactgagaatgctcatttatacacagctctcctcttaagcacacaaaaattaaggcatccaacaatcagataaggcaaatgcatttatcaagcatccagcgacaaaaagctcctagacgtctactacatgcagcactgctgttcgggtgctggggttatagcaggctacaagggaggcaggtctgcgttcatgccacctacattttaataagaggagaaaagaatagagaagcactgggcagctgctgaggagtgctaaggagaaaaatcaagggaggaacaaagagtgatgaggagtgttgatttcagaagtgagatcatggaaggtcgccctgttgaagggacatgtgaaagagaacctgaagaaaggtccagcaccatcaggatgtctccacgaaggtgacagtgtcttgtctaggtctgccttgccaccgagtcaccgactgtgagaattggaaggaatatcagcatccttcatttaacagttaggaaaataagaccaaaaagaggttacagtccaagttcagcttcacaaagacgtatctctagatagaagggaaaaaaaggagagcaagaaaatgttaaaagttgactatgcttagaaactgccaaaaatatttaacaaaatgtgccagaactagctgaaaaataagttcctgaatattcaatcaaatattctatatttaatttcatggtataagaatgcagtaatcgaataaatccttgctcttctcagcaaccacttacattgttttataaagttgatccacatcctatctttaggttgtagaaaaggatgctgggggagctgtcatcccagacccttaaatgtagttaatcccctggtaccaagcaaagctcagaatcttcaggacatctgcctctactaccttatgctagaccttagtatctagggagaatgacagcaacatcgtggtcatggttctgaggaaagcagtggaatgcacatcagaggaaaccaactaaacactcacctgtaatgagatgggaagtgattacactatttttcttcatggtatttatagttttaaggaacagctccctgtaagtgacatctacccactgccctttatcctcctattaaagcttttgtaacagatggtgtttatagaattggctactctgactgttagcactgtgaagacatgagtctatgaagaatgtaccccaattttcattacaccccagactaaagtgctaagtagtgatcttttgaatgaatggaatcccattgatagagagtcaattatgcctttgcattaacacacatcatcttttgttcattaactcagaaactagagtgagctggcagcctgagagccaaagagcttctgtgagactctcaagtgacttaacgtggctggccgatgactgattccttccaggtgaagcgctaagccccatcatgcccctgttcagctatggcagggttccaagtgggcagcccagctctcctctgggaggagcattgggcaccacttgagttgagtttgtccaggacctgagctgtattgttctgtgatgtgggacaatcttctcgagcagtatcaatgcttctgagtcacaagggtcaaaagagagttatttccctggggctacaactttctgagtttgcacaacttccagatgcagaattaatttcctgaggtcatctgcagcatggtgcagataggtcacttaccctgcaagcagtatggaaacctgatatctagaattgttgactattctgtgaaacttgtttctcatatcttatttcttcataatatcttgccccatcacatcttcaaggctttgtttgaccttatgggcactgagtaactttttccttttctgaatgcatttggcgtttactgttgaaatctatggcttctttagtgagtacttgccgagtgctcactgtgttcctttgaatggaggtagagtcctatgaaggataagtccttaaggcaggggctatttttatagtttagtatctatctttaacttcagtttggctggagaactaagatacattaaaagaaacttggcagtggggggtggctcacgcctataatcccagcattttgggagaccaaggcaagtggatcgcctgagctcaagagtttgagactagcctgggcaacatggtgagatgctgtctctattaaaaatataaaaattagctgggcatggtggtatgtgcctgttgtcccagctaatttggagggtgaggtggtaggattgcttgagcccggggagggggaggttacagtgagccaagatcgcaccactgcactccagcctgggtgacaaagtgagacccccatctcaaagaaagaaagaaagaaagaaaaaaaaaactcaagctcctcaaaggtggaaaatttatatataagatagctggaaaaataagactaagtaaatttgctttgtaatgtttacaataccgtatgtgtttagtgtctggatgaagaatgaataggttccgggcatgataatattttctttgagcacaaatatgttttatgattgtcagaaccagtgtggaaaattactaaagaaactaaatattcttttgcaaatgcacagtattttgacattttcatttcaaatcaagatgctggaataaggattcccccaaaacctgtaaaactcagcgcagatcccagcaatagatggggttgtgtgtccttgctagctcattgcggattgggggccagctgcactgaggatggccttagctccctgtctgctgagagcaggatgaaatcaatgactgactgatgtctcctaagtgcctgatatatggttgctgatgcagagaggttctggtgacagcccacactgagggatgcttatggagggcccaagtaggcgagagaatgcaccctgcgtatgtatgtggaagccaaggatccagctggcaagttggcaccagccaggctgagtacagaggttccagtctctacatcagaagagccgagtttcctgacctagagaagttattttggctttcaagttttcatctttaataagaagggtttggaataaaagaaggaatactgacaatagctgacgtttcctggatacttatgggtgccagctgctcttcttcgcgtattcatctgtgcaatccaaacagcactctatggctagaggccactgcgacctctcttttctaggcataaacctgagtccctggcccagggtcacagctggcaggctgggcactgacggactccaggctttaagtcacattgctacactgtactcagggtatctgccgcccgggcccagacccagagatccaccctaagggcgaggataaggagacagaggacaggcagatgacaaggtgggggcagttctcatgaagggtttccttcttggacactgatttcttcccaggatgcctgaggatgctgaccagctccttccatccctgtcctcctcacctctttccacatcccctgcagatcagcccagcagtgaggcacagcctagggtcggatgtcccatagatcatcatggaagctcagaagcaatccgttcttcattttagaggctcctctccgtcaagattctggaaacacaggagaacactgtgacctttctcagaggatgttttcctaacatgcctgggaggaagacttgaatggtggtgtgaaaatgtcttttcatgccctaatcaatagcccatcaattatgtatgtacttatgtatgtaaaccctgttaccatcctgtggagaggataggacttggtgatgtccaactattgagctctttcttcaaagtcttaaaggaagttcagtacataaaaccatggcagcgggttggctctggcagagtggagtcagtcagacatctggagcgctgtcctcactctgcctccccaccctcgggcatgcttgttggaactgacagctccactgctggcagtttataaatctttccagtgttttcattgagggttgtcaaaatgttaaggcatattaggccatcatggagcaaggtaacctccaaggcctttacctcttctaaataatgctttattctcttttcttctggtcatgaagatacagttggaaattcctacagattggctttgcttgaaaggctattgtagaccattaatgggcgaaatccctgtatttgaaattgtaagatgcaatgagggaaggcaatccacgtgatttccttgtgttcccctagtggagtgaaaacagatactgacgattgtttcctcattcctggtggcatcttgagatggtttggtaacatccaagctgtgcagatgttaccacggagcatggaggcttttctgaactcctacaggtttcattgtctgtgccactttttggtacttaccatttacgtatttgaactgtgtattgtttcacaggtgtgtgttttccaagttgccactctaccaaccctttttgtatattcctgagttcaaaaagcactttaaggaaacaaactgacaaaaacatgcagtttaagaggaggaaacaggaagatggctcacatgtagcttgagtgaacaatcacatttagcacagtgcaggctttcagtcttttcatgtcatgcgtatttttgtatcctacggacaatgagccttgactgcttttttaggcctcttaccagcttcctcctctgaagtgtagtaagtagcttcctatataatataatttgtagatgactaaaagcaaggcctgatcccacatatctcttttatagacctgctacattgccagaaaggtcttcattgctcaaccttacacccctcaaggataaaagctttctcaaccacaagaattcctgcagaatttggctatgtctcattcattattgtacggggtcagtcgctggcccaatatctaggctatagtaggtatctctaaactattgggaaacctgtagtcatttggtggcttatttttcagtgagtgcagataggagatggaatatgggtggatctagatggatagagttggatcacaaagtgaaaaccatcacttggtgggaccatgttggggaggatcctgaggatgctgaggtcagtccatgacgtctgtgacaggcacatgagggaggggccatgtcatatgtgtctcaatttgccatctctgcttagagcctgagtgactgcttgagaaggtaggcccaagcccagaggacagagcatatgagggtggatttgactgagagagttggtaacacactttctaagtgagaaatacggatgacaggaacaccctgcctctgcccgtggcccagctctgcttgagtctgtcactgtctcctttcctggaaatgtcagtgtcgcttccctcatgcgttttggagccttgagttcaggctaaaacagggccttttgaggggaggagaaaaaaggaaagagggcaaaaggatgaagtgtgatttcttaaacaggtttttaagaaaggagaaaagggccttgcttaattttgagacttccaaaaggttaggctacatgtaaagggaaaggtgaggttgatgctggttttacaagaactgctttgctcagttctacttggttcttatcaacgtcggtgacccgcagaactccttacgaagcagtctagtggctacaggatagcatccaaagtgactgcttagagtttatgaatcttcactaatgtgtgtgtcccagataacaggatggaaggaaaaaaaatgaaacctgtgtagacactgagtatgttagtttggaacagtgaggaaagctttaagagagaaatcagtattatatcagtttagccaggctcacaatcaatagtcatttgataaaagctgagcgtgtgtgacactctcctaacacagagtcctgtgattctttggggatgtctttgctggtgtatcagatagctattgctatgcaagcaccccaagacttagtgggcttaagacagcatcatgttatgaaaatcatgcattttcatctttaataagaagggtttggaataaaagaaggaatactgactattccttctgaatattggatgatctggggtgtgcctcactgtgtgtcagctcactggcttgcttgcttctgcctgggaagtggccttgccaggggcatcttttctgagcagggctgctccatgcatctctccttctctgcctcctgggactgggaggcatggtccttgcatggccatgacaagcgcatgcaagctctcctgagacttaagctcagaacaggccctggaacttccccctcatttctgtggctccaaggaagccccatggccaaagaatggggaaataggctctatcccttttgcagaagtaactgcaatgtacacagactgtaagtaaagggaaccatgaagaattgaggccgttagtgcaattaacatgcttagattactcttaagctcttattgttgctattagtgatctctctggaccctggaaatgtccagcaaggctttaggatggtagctgtagtagaagcatgagtggatagtcatgacctgcttttatcctcactgtcaatgtttttctttccatacattgttgaggttaagtttgctgaatggtaaagaagtataatttttgaaattgttttctgtcgtcagttagtaaatcaatcaacatttactgcacagctactggaggagcagcacctgctacttcctgggttcatggagccataggggtgaggagggtgacatttactgagtaatcacttcgtgtcaggaactgtgccaagaacctcgtaaactccagattaattgagatagacattttggtggggagatatctatgcattgttttattgttagatcaggcataatatatccaaagtgtaaagtctttggaaactctcgatgaaggaaagggattcagtttccaaggtgtgggctagaatgcagaaaataaaaatgtgtaagtgaaggttttctgtggctttggtaatggctgtgtttttgatatatagtaaacaatgataaatcgttgttcttttaactctgaattttttttaaaagaatgtcactgtgcacggtttgaagctgcaaagattgccttcgagagggaggagtcatttctccacgtccctataacattatgtggaatgttgtctgtcagctttggactgtagtttatatgtcagtgactgtagtttatatggagtattttgtttaacttttcatttgttcccaatgttacaattttgctttctcatagatatgcatatggaaccaatgcactaataaggttcatttctcctaatatatgctgtctgtacatttgtcgcctataatagttgttaatggttttaaagagggtcatgatagtccgttatgtcaaaagatgccattgccttctgtctttttctgtgcattcctggttttgaaaatgagggtacaatcagacctgaaaaaaaaaagcatatgactttgtttcatgacctacaaaaagtaatggtaagcaagatgcaaattcttattctccaagggtatatacactgtcaaacaattgaaagaagccaagactatctgaaaaggcctatttttcagatttcatcttggagacctttcatcatagttcctaccccaagaaaataactaatttgctctagccttatggaatagcctggaatggctgcctgggccatctgagaagttggctggtcctatccagggcttccccagttggcctggctttgctcaggggccgggggctgaactttagcaggttccactagtgctgttgggagctccacagagaaaggtcgaacgcttggtggtttgtccttgtggtcagaccccgggatttgacttttaagaatactctgaaaatgaaaatggatttcctgggaaggaagtatgtgaagtcattaacattaattaatagcttatcgaaaaattaggctttcaggctggaagaaagtaggcaggcctgaagaagggagctcaggaaggagagctggagggaccacagcagggagctggcccagaggcaggtgacgtcgcccaggaggctggacctcggggattgtggttctgtcaagaaaggatggttgctggtgggggctggggggctgtgggggctgggggtgctggagcagggaggtgtgacccaccccagggaataggaggagagaagtgggtagggttttcttggactctcacttcaccttccggttggacgagctgcaagcatgagcttctaagctttgcatcccagagtgttggcggctatggagatcctgcgggcctcactgccgccattccccatggccactcagccagcactacctaggcactgagctccgtgagggacttttttcctgctcaccttatctcaatggggtcaggcgggctgaagcttctggagtcttggtgaggctgttgctggattgaatatgagcagctgcagggctggaggaacccaaatctcagtggagcctgttcattgaagaccttactgataggttagtgccaaggggtgctgacaggtacagttatggggaactggcacatacgaggtagcagcatctgccctgaccttggccctataatcatccgtggcattgttgagaacagataaacagtaaccaacagtgggctcacatcacagatgttttcccttggtgcttggtgggccccaagatgttggggttcaaggtttttattatgtctagggagggccagaatcagtcctatctgctcgcattgagatggcctttgttcaagcaagaggtgaaattaagtgtccagaggcagaaatagatttcactctgggttctgttatccatggttctttgtagattctttctgaatgtccacaggtgtgctcaactgctaaattcagctgcctttgaaatcacaaaaagggctcaacaagtggaggtctcttccaccagcaaagcaaaggattgtgtaattcgatcactagggtaggctctgaggctgcgtggcccgagttgaaagctgagctctgcacggacagctggtgggtctctgcctaagttattttacctatctgtgctctgcttcctctcctcaccagaaaaccgaggctatggttgtatttgcatcataaggttaccaagaaaatgcaataagctaatgtacagggagcacttaaaagactatctgcacgcaggaagccctcgataactaattgtttgctgtaattattaatggtcaccccacatataggtgaggaaatcttgaattgccctggttggtgctgctgggtatttggctcaggtaagagtggtatagcagcttggctttttttagatgagaagctacctccccctgaaagggggctgagtttttgtctcctacagctgctcccctgagaagatattcagctcttcccaaactactggttgtttagaaggtggctgtgtacagagcctggtcatgctatgggtcacagagacacagggccactgcctgcacccacctggacagcacccttctgtgtgacttccatggggaggactgtgagtggtgccccagtgttgggatagggaccagatgactgcagaggaaacaccattaacatttgtctattcagcaaacactttactctcacatgaatgtcgatgtatctttgggcttcttataaaagaatcccacattcactcaacgtctgtgagtatagacattgttatttgttcctttcactttttaaagtgaattaatttgtacaatagtggttttcaaagtttgttgttcttgaaaaatcaccgatcaagcattaaaaatgcacacactggggtctcacccctgagaagctgctctgcttggtcattcaggaaaactcaggtacctacattttaaaaaaaattctcagatgagctgccaggcaaaatcacctctaattgcttctcttgttttagttctcccaacaacctgtaagagaaaattggacagatattcctgtccccattttagatgaggccgcaagtacttagagtgaaaatttgtttgaggtcacataattagttaacatattattccagataatcacagatttcttttttagacaacgctccctacatctcaatagcttaaccaaagaatgtgtcagagggccatctttttgcatctctgggttctgcagggcctgctgcaggaattggtgtccacagggggttctggagccaattctccacagatagtgaggtagttctcctgtggtcacacacctcgggatccttcacagccaggtgtgtgggcagacgagagagtgtggtcatgctacagatagcctggcattgacgttcatcactttagcccgtattccgttggcctgaactgaggcataccatgccgtgaggctcagcgagatgcaacggagtgtgggcagtgtcctcccggatgttcagaagaaaaggaccctgctgaacacatgcagtagtttccaccactattaatgaccgtaaggcaatgaatctaaatagtgaaaatctttgcatgaaacctatgcttttactgacattgtattgttgcaacaatccagggatgtagttatgtatctccctattgtttaaggatgataaaacagattcagagaatttaagtgacttgcaaaagtccacacccctgagaaacaagagagccagagaacccgtgggcagctctcagctctggcgccagggctgtgtggttgggacatacccattgaccttggaggcagaacaaagctggtatcaaaactcagatttcttgactgccatttcagtgtactttttccactacaagatatttcttactgttttgagcatgctgtattaccacagggactagcgacataggtttaagcaagtcttcagtgactgaaggagaaaaacatgtagtaaatattgcttaaatcttttctcattaccacatagaaacacatttctatgtagaagtagaagacatttctacttacctatcctgagaaccttctctctgaaaagctcacagcagagtccatctctcccgcttggcagctgcaataagtacagtaattaggaatattatttcttttctttttttttttttttttttttgagacggagtctcgctctgtcgcccaggctggagtgcagtggcgcgatctcggctcactgcaagctccgcctcccaggttcacgccattctcctgcctcagcctcccgagtagctgggactacaggcgcccgccactacgcccggctaattttttttttgtatttttagtagagacggggtttcaccgtgttagccaggatggtctcgatctcctgacctcgtgatccgcccgcctcggcctcccaaagtgctgggattacaggcgtgagccaccgcgcccggccaggaatattatttctaactcacaagagttcttctgcatgttagccaccccccagagaaaatagtctccattgttgttctctcttcagcatatcccaggtatgtttccaagcaagttttgctccactataagttgatgaggacctttttttttggaagctgatggcctggcaagagttagtcttaataggttgtgtttcttctcactttagctggctctccctaatgataatgtctgttcaagttgagcccagtttcagccagtttctctgggagtcaaaagcctgtagcacacccagagagccaccacctgtccacagcatatggtctgaaggcatctctgctgctctagcctgaccagccagcccaggatttccaactgtgagctcaccctccttgtaaggcaaacagggtttagccagcgctcaccttgacctggtgacctttgaagattgaggttgcaggagaatgcaattgagaatgcagcgggtttccagaccccatgtgagccatccctgatgcttcaccctggctccatgggaaggaacccagagccctgcctggctggtctcctgctaatgagatggaaagcaggggtcctggccacaccatgaaactcatgatgttctccactcttgtgtccctgccatggctcacattcagtaattagataccagctcattaattcctgctattctttcagaagggaaaggatggtgccctttgttctgctctgctgggccctgagccctcacagcatgaagtagctagattctgcctcactccagaggcggctgccactttctcaccccacagtcagcccctcaaccatgaaaagatgtaaggatgtagctaaattacataacccaagcatgaaagcacctgacgtgtatgaaaccatgttctcagacacttgtaggcagtgacaactttataattaggcatttcatccaacttatgtatcttacatagggaaattgacatcttagcaaaatttatttgcctaaagtcgcataggtaattaaaagtagatacagctgagactagttgctataatgcccagctaggagggagtcggtggaagaggtgtcatctattttcctttgaaggtttgtaagtatttgacttttcctgccctgagactgacttgcctctgaggaggcccatccgacttagcttgaacaacccggattcttgtctttagtcaaaagcctctaaataaagaatacaaatcagcttaacttctccaaggtctggcaaagctttatacacctttcagaaacagaacacagcaaatctgcctcagcaaacatgtgcatacgactttcatctgagctatcaggaaggcatcttatagacacatacaacggaagcccagagggctctggcatgttgcaaaatcaaacagtccagaaaactttccaccccagaccactattcagttgtcatctgaaataatggaagtcagagtcaaactcatcaattaaacgagaattatttatttatcataatctctactgcctgctgcttcaaatgctttctcatgaattaatgagctcatctacgtgcatgtcaatattttgttttaaactacaaaataaaacacaggattaggttttgttctcagtgtctacctttctgtggcattgatgcagatagcaactaaggattaaatcacagaatggttccctttttaatttatttatagaaatgggcttttgcttttattagtgatgaatgaagagagcttgacttggggaaatttagactgagattattgaagtggcctagagtttggaaatttttataaaacccaactgtgcaagtggattgaaattgtgcttaagaacaggctttcatgccagacttgtgccgaattccatttggttcctggcagaaaacccttgaagaatggtatttggttttgtttatttggcatttcaaatactggttcatctggcccccatcctgatcaaaaatagtcagaagtagaaatgggtacttgagtggcagcagagtggattcatctgggcatggcagcacctagcgtaggtctccaatatgccattgagaatgttgttgagtgcaggataacctttaacataatacccctatccctctcctgtttccttgctggttgatcatctgccctgggccacaaatagctctccctctccactctcccaaggaagaaagtcctgacaaattactcccttaacccagctctgttcctgaaggcttgcatattccatcacagaacttcctcttgggatggagagtaatgttgggacagatgactgtcctactttctagcaatgaaaaatgattgcatgaagcctcacattcctgatgctaatgagaatctgtcctttcagctggcgtttgcatcaggagatgccactgcttgatttgtaatgttttgcactaacactctgagtgaaccctgtctttgggccgttccattgcacaataggcagttgaaatctatgcttttctcaatagggagtacaaaaaattcatcattttaaagtgggctgtcagatctaagaaataaatctcagttcataaacttgaaaaactcagaagtgttaaaaattttattcactaagaacataacatccaagacgagagatcaattttgcatattattatttctacctgaagtattccatctcacttaaaagaaatatttgtttggaagcattggttggtgctggtagccaaggctgtccaacaaaaaaagcgagtttttaaagaaaatgttattccctaagggtgaatcttaaaaaattgccaaatgtattcttgagatgaataacaggaagcttagttctagaaagggcctgagtgattatcgaatccattcttcatttcacagacgagaaaatgagtttcagagatgcaaacattcctactatcacagaactagtaagctggagaacagacattaagacctgtaatagtgattcccgtgtgaatgtttttatgatgaaactgtacaaaatgatagaacaataacaatgtcaaaacacctatcactaagcactttcatatgtaatatctttttttaattataacaaaatggcaaagtaggtgttatctccatttcacaaatggtacaactgaggctcagaaacattaagcaactgtcctggggtcacaaagaagacactattagagccaggtttagtccacatattcaatttctttgtttatttccttcactttgcatgagaattcctttttgctgtctttcatttttaagcagaaacctttctttaaagacactaatgatcaaagatctaaattaaaaactaaaactattaaatttctagaggaaatcatagccctacatctaatatataatagaaccagatggaaattctagaaaattctgaaaagtacaatatctgaaaaggaagacaatacttagcttggattaggcaatttgtttcttagatgtgacaccaaatgcacaaagaacaaagggaaaacaagataaattgggcatttttgaaattaaaaacttttgtgcatcaaacaccattaaggaaatgaaaagacaattcatagaatgggagaacacttttgcaaattgaatatctgacaagagacttgtatctggaatctattaagaatgctatataattcaataacaaactgacaagtaaccctattgaaaatgggagtaccaagtataccttttcatttaaatcattgaacagttcacaatggctgttgtaaagtttttgccttgttactgaaaccatcatctcttggtctatttctatggagttattttttcctagttattggcagtttgcttatcttttatgtgtctaataacttttaattgaatgtagaacattatggatcttatatttttgagaatctgaatgtttaaaattcctttgaagagtttgtgttttcttctggaggcagtttacttactggctgtgagctcagtcctgttgaggctgtttcacgacaggctgtggctttgtcagggtgggtgtggatcagacatctggtcatcaaccctgcatattccagcctctttcacaggctcactcgctgatttctgtttctcccacattaaggccactgctctctgatagtctctgcctctcccaggctggaaaacagccttaagcagagagcccttgcaagtgaggagccccctcatgcttcccccttcacctccagggtcatagtcctgtagcgtatgtaatccccttcctaaaaacacttgctttatatatttccctagttgtgtaattgtttatagtgagagaggaagcctggttactcatgactctattatgagaagaaccacaaatctctcctacttcattttaatcattcgatgttagatgtatttaaccactttgttgccatgtttaaatttttatggggagaagcccaaggtaaataataaaattaacaaaacttttagtccagtgtgtattcctcagagaaacctcaggtttcttttcttttttttttttttttaacaaattcaggtctttgttctagaagttaaaaaaaaacaacatacaaccaaatatagttaaaacaggaaaatctatttgtgtttacttcatatctttctgttgggtcagatgataatgtttagaaaaatactgtaacattcttactttatgtggacaaacctttagaggctggcctctctgtagaaggattgcacagggaaataattttgagcctactttcttgtctttatcttctatgttctcttctcagcttcctgtcttgattggcatggaacttgctctgctcctcatgtttctatttgtttaggaaattcactaggagtgtacaagggacagattgtcagctgtcatccaagtccctttcaaataaccccactatcctttgccttaggaagtctgagcctccatcagatcccggtcacattgtgagggaggagtgaccagccaccgagggccacctcctgctcttctttcctctctcccctttgcccttgaggtgccctcaactcccaggctctctaatcatgctcttcccagcccaggattgccctggccagtgcagctcttccttaggttctagaaccactacctaatacctaattccaatagggtccttttgactgaagctgacttaatgtgtttgagaaagcagggctaaaataaaaagaccctaatgtagcagaggccttgataaattctaccgaagtgatgagaactgtgggaatttctgactgagcccaaaagttattagaggcaagaatacttctctctccagtaaatgcctccccacctccacccccatttatagaaactttcaaatttatactagcataaggccaaccttatctgtgaccatgaataagctatttcactacctcgttgttctggtcaaaataatgcatggggctgggctcatgcctgtaatcccagcactttgggaggctgaggcaggtggatcacttgaggtcaggagttcgagaccaacctgcccaacatggtgaaaccccagctctactaaaaatacaaaaattaaccatgtgtggtggcacacgcgtgtagtcccagctacttgggaggctgaggcacgagaatcgcttattgcttgaacctgggagacggaggttgtagtgagccgagattttgccactgcactcgagcctgggtgacagagtgagactctgtgtcaaaaaaaaagaagaaagaaaaaagaaaaaaaaatcatgggctagctactctgcttgtattttttgtttctgtccatcctcttacttgatacccctccacgttctaaaaacaaagcctcccttcacattttgagtgtgtctgctatggataatgaggcagcaatcctggttctaaagaattgtgataaagcagtcactaaggatcccattaaaggtcaaaccatctaattcttaatctcacggcacctgcttgataatgatggatacttattaaactcattccttctgggtctcagaataccctttagaatgatccaatttttcattcaggcacttgaagttcattaaatgaatgctggagaaactgttttctcattgacgtacttgctttaatgaaatgagaaagtaagaagtgcctgaatattggtggtggttctcaaacccaaggaaatctaggggtttgtggagatccagaatctcctctctcctcaccacttttatggcctttatctaattttacttttcagccacgtttgatgtagctgacttccatctcgaaacactctcttctgattttccctttgattgcactatccactcctttttccatgtcctcgaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttgtctccgtaagtgaactgcaaactcagttttcaaagtgcccatctgaccactccactctgatgtctaacatgtgctcgcttacatgtggccagaagagagctcctcatccccatggccatcgctcctccaccagtgttccatctcagtaaatggcaccaccaccaacccaggtgctcaagccacaagccctggagttgtcgttcgttcactttccatttcacctcatctaaccattcagcaagcctcatcgatcccatctccaaaatatacccctaatccatgcagtacacccacctccccactggggctgcaccagtccagccccagccactgttgtctctcactggaatctctgaagtcactcccaagaggtccctgcttccactccccctcccacacccattctccctaagacagccacagggatcctgttgaaacaagtcagatccatcaccccctggagtacctggcctcctttgcacatctcagaccgaagctccttactgacctctaatggtgtgcacgccctgttcctcggcccttataagaccccttttccctgcacactccatgctctggccatatcggcccacgttctattcctcgaatatatcacattccttctgcatcagtgcctttgctcctctgccccgaaggctctctcatagatcttcccgccattcaagtcagccccatgatacctccgcagtgacgcattccttgaccactctacctaaaatctctctccccccgccacacaatctctttgtcttgttttatcttcttctcaacacgtatcactatcaagacattgaacaaggaaatactgacggattttcatttcagtttcccccttagagaaggacattgtctattgttttttgctatatctgcaatgtgcttggtagttaggaagcattatataacaattttaaaaatggaaacattcagtttttaaagtaggtttattttttttttttttcagagaagccaagtaactggtatgcgtagtaataaaacatctcaataaagaattacaagacttgaggatctgggcatggtggctcacacatgtaatcccagcactttgtgaggctgaggtgggaggattgcttgagcccaggaattcgagaccagcttgggaaacatagcaagaccccaagtctacaaaggtttttggaaaaaaattagctgggtgtgcagatatatcttcaacatactgatttgctctattttggatatatacccagctgagagattgatcatttggtagttttagattttgggggaactttcatactgttttccacactggctgtactaatttaattcccaccaacagtgcacaagtgtttccctttctacacatcctctccaataaaagccacttcattttgagccattagtgaactgagagaaaacagcactatggagggagaaagtggattgtttccaagaagtaggtgggcaaggagcaatgaaggaaagataataccaaggcaaatacctggaggatgttaagccaagagcatcagaggagaaaaggaatcatcaagaggttggttagtgggtacaaacgtgcagttagaaggaataagtaatagtgttccacagcacagtagggtgactatagttaacaatatatgttttttttgagacagggtctcactctgtcacctaggtgggagtgaagtggtgcaatcatgtctcactgcagcctcaacctcctaaacacaagtgttcctcttgcctcagcctcccgagtaactgggaccacagcatgtgcccaccaagcccagctaattttttgagtttttgtagagatggggtttcactgtgttgccctggctgagcttgaactcctgggttctaagtgattgtccctcctcgacctcccaaagtgctgggattacagatgggattacagactgagccaccgtgcccagtcaacaataatttattgtatatttcaaaatatctagaggaggctgggcatggtggctcacacttataatcccagcactttgggaggctgaggattgtttgaggtcaggagtttgagaccagcctggacaacatagtacgggcctgtctctacaaaaaaagaaaattcaaaaacttagttgggcatggtggtatgtgcctgtagtcccagctactcaggaggctgaggcatgaagattgcttgagcccggaattttaaggttgcagtgagctatgatggcaccactgcactccagcctgggtgacagagtgagcccttgtcctaaaaaaaataaaaaaaaaataaaaaaataaaaaaaaaaaaaagaaaaatataaagaaagaattagaatacttgaaacctagccaaaaccttatccttacttagggtgatcctgtgcttccatttgctaatccatagatactcctaatatcttccttctcttcttcataagtgaggagataagatgaaataaggaattcgtaaatacaaagagagtcataaagcatcacataaatgttatgtttattttatattgaaatgtccacctgaaaaactttctctggcagagtgcagggccagatgaaattcacatgaaggaggaacacctgatctgtatggccctgtcattattatgcatacccatggaaccagctgggcactcagggttatatgtggtagccacagcagggtgatttgcaacccccactcctatatccatcaagacaaggccaccacgaggccccctatcctgctgtagatgacctgaaatacgctgtccccttagaggttgctttctttggaattgatcatgaacatctgtttggtttattgcagaacccacagaggccaacacagtgcctggcacattctaattgctcaatgatcttgagatcaataagggggtgaaaaatggctgctggtgtaaaaagcaggagaaaggcactgaaaggggatgagagtggacaccggagaccattttttgcccatttgttagtatttcatccactctgcaactagtctcccagtcattcctttatttttcccctgtatgagttgaagacgactctttgtggagtctaggaacaggcaagtgtccctatatatggaaaggaaggaacagttcacaagctttctaagctcacaacccagcttgtctgggcttttcaatagagtggttgccatgacattacataggagagcctttcaggcagttcccattgctaagggcaaagggtgactgtgatattaaaagaagcatttgttgctctttatactcagaggaaatcaaggtgaacttgaactcattaaaagcaaggctgagcacatttgcatgagcagaatgtaaatacaggaggcttcttgcagatgagcttctctcttgcagaagaagagacccagggcctcctgagcctgtttgttcttaattaagagagatccttttgggatgagagtgagtttgtaatggcatttctaccacaatgtacaacttctcaaatatctccttcccccatatcttcaaagttttaagtacagcccttagtgcaagtttgtaggggaaatatggaaaaatgcaaaacaaatacaataaacagagaaaacaatttaaaatgattctacacacaaatgaataatttaaacctccatcatgtttgctatctgtgatgcatctatttaatattaataacttgtgaagaaaaatgactgtcaccatttttaacaagcctagtctattctggctacaaaccttagatgactgactattcctaacagggccctgcttattaagagtctgttatcttctttaaatttaatttcatgaataatgaaatgtttataagaggaaaacaaatatcctgtctaaagccagcctctccttactcccttccacctctgtcaaatatttatctgcctctaccttcttcctttttcttttcttttctcttttctctcttctctttctatttcttctttctttctcccttccttcccttttttctttatctatctatttcttcctctctctcttccttccctccttccctcccttcctccctccctatctctctatccctctccctttctttcttttcttagttttcaacaccaggctccatatttaatgcacacagtgtaactagcttcaatagctgatcattctttctccagagatgtcttattacgaagcaaggagcacatacaaagcagttgtattgcttttcaaattccctcttcagtgaacatagtcattaaagaattgtatcaagaagaaacacttttataatgtggctgtccccaaattctaaagatggtgttattattgatttagtaatagcttacaaatcatgacccaaaattagttcttctgcacttatgccccaacctttgtaaaatctttattgaacaaccatggccagtaaccataacagataatgttctattaagtgcagtttttccatgggtcatataaagtctttttcttggagctcatataagagtccatggaaccttcattcactttggtgtctgcagggaactcttttcctgtggagtctgagtgatcacgtggaatctcaccccatgctgcccacagaactgtccatctaggtgtctcttgctgaccagactctgggtgtacagcagagctgacagcccaggtttcaaataaaactttccagaatttcacacacacacaaacacacacacacacacactcatacagcagctctgctgtctaagatgtcaagatgtcgttttgggttttatttgtttacattctgaattctgtgtccatgtgttttaaattttcctctagataaaagcgtgatagagcatctctgtggggaattgctgtgaagaagtcccactgtgggatgtggtgcagggtgaagatgcagatgagagaaggaaggagaaagctcagggagagggaagtagaaagaaggggaagaataaacggttggagaagctgcctgatgactttgagcttttgtagatcagcggatccaaacctcttgttgtgcaggaagtgttagagaacattaaaagattagcctagagtctcaggtagttcaagagtcagagttgggaccaggtcttctggttctgatccagagctttttctcctacttagctgtcattcccatgccattcatgtcatgttttaagcagttcagcaagcattcttgccgtgctgacttgtctctagcatgatgttcaagctctgaaaattgcaagtgaatttaaatagcctctgacctcagtgagctcaaattctcactgtggagatgacctccagccccaaaacagatcagagacctgctatgtaacacatggggcaagtgcaagagtgaaaggaggaggatttggggatctagaaaggtctggggcaaagcggcaagagaaacatgaggcatttaggggtgaacttggtggaagggggaaggcagagctgggaaaagggcaagactccttggtgaccaaatgggtagacatgtgacaaatcactgcccccattgtggaggatacaatgtggaaagagctgtgagcctctccccaggaagctgtggtccacatggatgatgatggggagatgtgggaaacgccaggcagagaggaagagagctgccggggaatagcatcattccaccaacggaggaccacagggcttggtgtaacacccacatgcagagggtaagacgaggacccatcccatcatcagcggtgccaacgcttacattgcagcaccttaccactcagagtgaggcttcagcactctgcgaacgtttgctgctgttattcattgatcacccatgcacctcacaacagccgtgcgagactgattgggctgtcaccactttctccatttagtggacgaggacaggaagtcacaaaatgggcctgagatcttagagtttgccaagtcctgcagccatatgtaagtttccctgatgccggtactcaggggtgctgtgctacttcagtgtctgctcctcccagagtgctgtagcccaggagaagaggcctttgtgccatgctttttacagcagcacctccagaagtcacgtaagagacctggcacttccagaatcctttccagcctacaaccattttcacataaaaatgggaaaaatggaggcagaggaaaccatatatcccaaacgagggccagttatcccctgtgtatgtggggctgaaggctcatgatgcagtgaaggaccaccatttccctccttccagtgtattaagaagacatctgggtgttccagttccatcagctcactcatccttcagtagagacaagtgagcttggcacgtggatatgtgaagtgctgtgtgcattcagcctcagtctcctatggtgtcccagctcctggactctaagcctccctgtttcatttatcaaagagattggatgacacccacctatgttggtgagaatggatcttcttcatctacccattcaaatgctcatcttttctagaaacaccctcatggacacaatccagaaataatgtcctaccagctatctgggcatcccattggccggtcaagttgatatccagaattcgctatctcagctgttaaggccaactcagatctaaggggaggagaattcaactccccctctcaatgggaggaatcctagaactgctagagtttcctgccaaccaacattcttaccaagtaaaataaaacaagaataaactttacattcggctacagaaggtgatggaagaggtagagcaagaggatctacaaagatgctaatttcatttataattattttgtgatggaaaaagtaataaattattatgagttgtcaccagactctttcttaaccagagaattctctttctttggaaaaatattttgaaaagctgcttgaccatggcaagtgagacattgaggacccaagcaacagatagatggtttatggcatgctgagtggagagtaggggacacttgcatttgcctttgggagggaaggagagaggaagaaatagaaaaaaaaggggaagaaactggagaatgtgaaagatgtgaagcatcatgggaaagtagaggccgggaaaaacatcctagtgataaaggtagaagaaaagagttttaggcaatgcctaatatgtgattgaaagatgcatgtcccccttcctgccatggatgctcccccctgaaattttaaggcaaattttatagactaacggttgccctgtgcaagtgttgtcttgtgtgtatgtgtggagtgtgaagttggggttgcagctgaattgcacctccagttcatcatgacttcgtatctcattgcatagtctggaaaaaggacaggcatagacaaaggaactcaccagcagaggtggccagaagaagaaatctttcctggcaattgaaagaaatcttagtgcagattgtggtcttgcactaggatgagacagaggttggagcttgtcttcctcagacatcaaagagcggggagaacccaactgccaactggtttgcatgtggcttgtggtttgacagctgactctttcttaacttctaatccaagggtcagtacaaagccaattccccttctcctccaggaggaagaaccttctacagcctgaggtacccagtacttgtcctgagtgtaagctaggatgacctctggatccatcatgctatatttagtctctgtttcacctaacactcaggattccatgaatgtacctttagtgagtccaggacaccttgtgaagattgcacgaaccctgcctgggaagtgacaaaggtgcagacttacccttggcatcttttgtacctttaaccacagagttcacatggagttgtgaccccagctcatgtaacctaatgcaaggtgaataatacctcctacagcaggctctggaaatgtttcttgtctgcacacacacacacacacacacacacacacacacacacacacacttcttaagtctgcattccccaaataataataaggggcatgttgctctataacaatcagcatcacgaaagcctacaggactttgccattcggtttaatggaattggtatatttgaaatactgcctttggaatttttttttgacagagtttcactcttgttgcccaggctggagtccaatggtacgatctcagctcattgcaacctccgcctcctgggttcaagtgattctcctgcctcagcctcccaagtagctggaattacaggtgcctaccaccatgctcggctaattttttgtattttaatacagacagggtttcaccatgttggccaggctggtctcgaactcctgatctcaggtgattcgctcgccttggcctcccaaagtgctgggattacaggtgtgaaccactgcctctggtctgcctttagatattttacataacagattgtattacaaagacctacacgcctccaaaaatactttggaatgttttaattatgcaaaaattgagaaaatagttaggaaagatgcatctgtctctgttaagaataaattcaattattagaatttaggggtgcccaacagcttacctgcagcaagattaggttgagttctactaccttcaaatgcttacctatgacctttgaagttctgattattctgggagcttctggtgctacatccactcaatctgccaggagaggaatttatcctacaggctgcataatttccttctcagctgtaaaatatctctttataagaggtgtgggcgagaaggaattatgggagcaaatacagtatttatcacttgaattaaacgactaaacctggcaaatagttcagctatcgatccacaaatagtatcaatccacaaattagcagcctgattcagataatctgatcagtagatatagttatatgtgagcatcataagcatcaaagccacttttatgtgtattatttttcttgtcacccacaaatcatgttgcaaagattgatagtaattgaataaattgccatgtgtacttaaagactgggcttgttggagacacaacacatttattagatgatcagttttttttttcctgttatgtcaatgctcactggaacacttcttttcaaatgtaggaaaaccaagctaactagatctagaaaaacaagcagaggtttcaagggatgcctttgaaaggtggtgtggtatcagggagcacgttgaattggaagtcagatgtccatgtgtggattcctttcatggcactccctgattgagacaatctgtaaaatccctttaacgtgcgtatgttatgattgcataatgtaattcttgtttagggtttattgtgtgactctttgctaagtaactgtactgtcataaatggagtccgagcagcggggcttgtctccccgtgagtgtgagatctgcatgctgccacctttctcctcctacttttctcgccaggtaccacagtctgtgtaagatgcaccaggctgatattttgtaaaatcaaggtcttcaccttccatttatgtggcacgagctggaatttgccagggtcaaatagtcaaccaggagttctttatggattcagccacatgggagaacttgagggaccttgcatgtcttatattctccaaaactccatccccacaggcttgccagtgtccaaaaggcctgatttttgggggaggaggcagctctaaaatagtgtcaattctagaactccttttttaaatgtcccaggaggagtaactattggcatcatcagtatttaaaactttgggctaattacatcacctgattatttccctcctttgtgctttctagagggatataaaccaatgagagtcttgagaggtggagtcagttcagctcagaagacactatcttgagggaaaaggccatgatgagtgggtttgtatgttgaattggaaagaggagaagggagatgaagagaaatagggtagggggagtactgagaggaaggatctgaagggtgatagagagaatgctgcctttggttaaaatttcaccagtgtagactgtgtttatgtagcttagtcagaatctcccttcatcctgtagtgctatgtttttgtttatttatgcaatactcttcctgtcaactatcacaattaagaatccctagtgtagcacagttatgaatgtggctgacctttcttaaaataatgtcctcgagctctgtagcactttaaacatttcaactcttttgcatatttggtttttcataatgtaggttgtaacacgatagaaggttagggaattaattgagtgggccatgatcagcttaagaaaataaaatgcaatagaaatatacctagtgcataataactagtagaatgaactaatatgaaactttgtccattatctatgtatgtagtatgtgtttactgtattgctatataaaatatatttctcatagtagattgcagtcacaaaagtttgaaagcctttgaaccccctttgaccatggaaaggaagagggattctgtacaggaaatggttaactcagcaggcctgggttgctcaaaccgtgcacattctcagaaagacctgctttgggactggcccttggatggtcctgggaaattagccaccaacctttggaatagtgtgcccaataagaatttttttggatgccttaggcttcagcccacatgaaaccagtttgatgactttatcctaacaatgtaatttatgtatggtgaatgcctgcttttgctttggggtggtgtgaggatctgaggtcaggtacgcaggtgccacatgcctgcatgactaacccccagtaagaaccctggacgccaagccatgggtgagcgtccgtggttggtaacatggtttctgggaaaattaatagagcccgtgagactccactagcaaagaacacctggaagctttcacctggtttctcctggactctgccccatgtaccttttattttattctgatttgaactcatatccttttgctgtaatatatcagaacagtacatctaattcagaaaagtaagcttttctgagtcctgtgaatcctagtgaatcatcaagctttagagtagtctcagggaacctggcgcagatgcagagattagacttgagacctagagaagttaagggctttctagaacatgtagctcaagcctgggcctggagtgtgatgaggtcatggacattaagctggaatgaaggtctgtaccaactcagtccttttctggtgaggcagcatggaaagacattggccttttctccatctgtgatgacagtgatccctggacgtgacttcttcaagtgtccttagtgagtttaactgggtaagagcaaaagaaatgaaatattttattcctttctcagtcccccatcaaggacatcaatagcataaaactgctataaaataacaaagcttattataaactttgcctccaaaagtggttctagcctttctgtaatctttcatatgagcttgttgttctgttgatcaatgaattcggtaatattctatttttaaaattattttaattatgatataaacaaatgagatacctcttcagagtccacatgaatggaaatgaatataaaatcagaatccaacacataaaaagaaagttcagcaaatgcaggactccagtctccactgcttcacagtagggtttgtccttgtgttttcttgttttgtttgggaaaataatgcaaaagagatttgttgtaaaagctttgaaatttaattatgatcagggagttctaaaggaaattaaacatagcatgagtacttttaaaaaatatgaatttaatatagcatcttatcaaataattcatcccacacggctagctcacttcccaccaggaaatagaaaagaatttttgaggactcttaactaataataatttctgaatttctctgacaccttcactgtttctaaacattttttttggtcatgttaacttacttgattcttcagagtttgcttattatagccatcactttctaatagtacatagtttgaaaagcacttggccgtcttctgcattctgggaacatgtggcttcctgacccacagaggatggcttctcgctgtgtcctcatgtggtggaaggggtgaggggtctctctgaagtgtctctgctaagggcgctagtcccattcttgtgggctttattctcaccacctaatcactcccaaagtccacctcctaacaccatcgcttcaggggaaaaatttcaaagtatgaatttggggagggggcggcattaaatagtcgatgccactccccatgctttcttttcctctgttgtggttttcagatgaacagagacttctggagttgatttgctgtcttatttgttctccctgcttgttctcgctcatctgggcaggtggtttgtcccttcttccccttatccaaatgataaattcctctccctcctctcctttcctcttccagtatcttccttcagctcctcctcttaggagctcaggaaatctgtctgcacctatcatactgacagcatgagcccaaatgtttttccgtagttcatcctggatcccggaaacatgggtggctgcctgcctgccagcctcagtttatttcccagccttactggtttgtaagctttaattttagaaaagaggacagagccatgcagtccacagaccactgcatggtgcttcgtcaccaccggccggtgctcccatgggctgcccaggtgcccaggcgtcctgggtccccaccctcgcatggctgtggagccgggacagctatgacatttgtgtggggttcttaaaaatgtgagaagctcctaatatgttgttgttaaactcatcctctctgatagaatttaattttaaacacaattcccccgaatacaccctaatgtgcttgtttcatttctggagactgtatgcatcactttccttgtctggccaaggccacaacagcgtttgcgttagccactgtgtccctgagtagatggggccctgtttactcttggcctgctccgtgggatcccagcccggccctactggacctcccagctcttttacaagtaacgccttctttcccaggtagccccattttctcctccttcatgacacgcctgtgggtccctgctttcctgggactgtcatcgatgtgcacgctggtgcctatgcacatgctccccctgcatcctcctcggtggggctgacacgcagggacttgcccacatcttctcatcttgatagaaaggatccctgtggcaagccctcttcctttcttcacaaagctgcgttcctcctttcccctctcctttggatatctgccctgaagaagctgatagaagcagatactgcttctggtaggccccgctctgcctgctccgatctttcacttctgcccactccatgctatggccttctctgtctcttcccttgttaactccctcgtctgcatccaattcctgatgcctctgacccctgacactgtgtgctgcccgcagccagaggaaaccacgttctggagtttggcagacctgaaatgcccacaactctggccttacttatgggaggcccttttcttcctcttccaagctctgagcagctccgaccacaccatcctcacactgccacctcccctctgtcctcgaggcccacagtcctgcaggtgcctctgagagtccggcacggtggggagtccacagggctactgtcacacccatactaacctagggagcctgtctctgaaacactgccacatacttgttttctcccatgttccatgtttccgatttaaatgagagacatgaccatttctatctggctctatgtccatgtcttccttgagacagtgcagtggtggattagaaattgtcttatgtcagctgggcacagtggctcacacctgtaatcccagcactttgggaggctgaggcgggtggatcacgaggtcaggagatcgagaccatcctggctaacatggtgaaaccccgtctctactaaaaatacaaaaaaaatagctgggcgcggtggcgggcgcctgtagtcccagctacttgggaggctgaagcaggagcatggcgtgaacctgggaggcagagcttgcagtgagctgagatcgcaccactgtactccagcctgggtgactgagcgagactccatctcaaacaaaaaaagaaagaaattgccttatgtcaaaaattagcaattttatgctgggcatggtggctcacgcctgtaatcccagcactttgggaggctgaggtaggtggatcatgaggtcaggagatcgagaccatcctggctaacatggtgaaaccctgtctttactaaaaatgcaaaaaattagttgggcatggtggcgggcgcctgtagtcccagctactcgggaggctgaggcaggagaatggcgtgaacccgggaggcagagcttgcagtgagctgagatcacgccactacactccaacctgggtgacagagcgaaactccatctcaaaaaaaaaaagtaaagaaaaaagaaaaaaagaaaaaaattgccttatgtcaaaaattagcaattttaggccaggcacggtggctcacgcctgtaatcccagcactttgggaagctgaggggggcagatcacttgaggccaggtgtttgaaaccagcctgggcaacatggcaaaaccccatctctactaaaaatacaagaattagccaggcgtggcggcgcacacctgtagttccaagtactcaggagattgcagtgggaggatcactccagctcaagaggttaaggctgaagtgagccatgttagcaccaccgcattccagcctgagtgacagagcaagaccctgtctaaaagaaattaaataagtagcaattttggcccctggctatttctctgcccctgacctatgtttttctgaaatgttatagacatcttccaaactgatttcacctaaatatcagaaatcgctcatcatggttcctttgtccagtgctgtggaaggccccagaggaggcttctgtggggtggtgagggcaccaggtgtgagttgggacctgagacctggtccttgttcttacagccgtgatgctgatgattaggaggccctcccagagcctccagacaggcttacaccatctggagcatgggcctgggtgaggcctcgtgagctcctgcatcataacggtgcttcctgctgctccaaagctgtggaatgtgtggtctgggaacagccctggctgaggtgagcgcatctttgcttgccttccacgtgacagacctggacctcagttcttgggaaggcgtccacgttcctttcccagcttccccattggatctgacgctctcctcttgtgatacctttacctgaattgctgggagattcagcgtctggacttccccactcccagccataggaaaaccttccccccagaagtccctggtgaccactcacacagcctgatctgctgccaacatctaccccttctggaagcagctgtcactgtttccagcgtgccagcctgacatatttcagagtgtctgcatgtctctgagctattaatacacaaaataacgtaagccccctcttctggactccccagtgtgtctgagaatgcctagtaagcatccatctggttacttttagctctaaacgttggttactagctcagcccaccaagagctcacatgcccaagctctccctggttgtcttatcctccctggctattacctctccctggctattatctcttactgaccattatcccccagggcgaatacaatcccttcttcttcacactgaaagccaccactaacacaatgatgatgtgtgtttaatgagtttcacccgctgaagttttagataaactatttttttaattctaatcttgcaaacaaggcttctgtgttcctctggtttctgggtcttcctcatgccaagaggccctccctaacaccttagccccagacctcttctgtcatctcagactctaaagcaaggtttcttaacgtggggtcccaggggcctgtgaacttaaagaaacaaaaaggtcataattatttttattaaagtctcactaaaaaactgctgcccttcagcatgtctgtaggcaaaatacacagtagttttggcattacctgtgactaaaaaaaatcacagatattcccatatcacagtggcaattgcagatatcttgaaatacaacatactctcaccattatttcaaagtcatagtaggttttaggcatacccctatttgataagctttgagactctaggcagacactcaagcaacagagctggtcagtctctggagattcccttctcaagagtcattcaggggcacgacctaaaggaacgagctttagagtgcagtttaactcaacagcctttggagaatctagcatttctggagtccaggctgtcttttccttacaaagtaaattatcaaatttgcattgtttatcattgggtatccttgctaaacaggagtctcattcttttttccttttttttgttttttttttttttttgggggacggggtctcgctctgtcacccaggctggagcgcagtggcacaatctcggctcactgcaagctctgcctcctggcttcatgccattctcctgcctcagcctcccgagtagctgggactacaggtgcccgccatcacacccgcctattttttttttttttttgtatttttagtagagacggggtttcaccgtgttagccaggatggatggtctcgatctcctgaccttgtgatcctcccgcctcagcctcccaaagtgctgggattacaggcatgagcaggagtcccattcttataagcatcagaattaaaaactcaaaattggatatctgatttgacaggcaagtcaagggagtgagctaggcagataactgggacaaggacgttgcaggtggaggtcagctggcataaacaacctgaagcaccgagtgttgctgagaaagagcaaggaagcctgtgtggctggggcctgaatgaaggaatgggaaggaaattagcttagagaggtagcaaagcgtatttatccttgtataccgttgggagcactgattttattttatttaaagcatgccttcttgtccaagacaattccccagtaaaatgttactagtttatctaagcccagacagccatttccctgatgtatctttaaaaataaaaaatctaactcctgtgttttaaatacattgtgaatcattaataaagcaatataaatacattttatttttgtatatttataactatgtttcaaaataatgcattttctttgcaatctgacatattttatcttatatatttaaacagaagattctgacaaatgaaatgctggcatcaccagattgttctaggagttcattttttttctgtctcatttttgtctaaagagacaaaaaagatctagaaccttttctaaattttagggcctgaatcccctctctctttaaaatgtgtccgcaccccccaccgaccccatcccccatccccccctacccccttgttgtgtggggcaattcagccttttcaggtggctttatatacctgtgactgcctttaaaggtggctttatatacctgtggctgcctttgaaggtggctttatatacctgtggctgcctttgaaggtggctttatacacctgtagctctggggccttccaagctaagcaacagtactgctaaacagttaagtctacatagttcctgggtggtaagtgatttccctgtattatttcacaaaatcataaaagcatttatttgcccagtaccccacaagtgatagaatctgagtccagaggttcggccaccagggctccagggcctgaggttttactgtgttgtgtgctgtggatgggttactatatcctttgacataaatatatacatacttggcttatgtctgctttgtccccagaatgcacacatatctgtggttaagacagtgttccttctttctttctctctcttttcctttctttgcccctctgcactggcattgaactctggggagaagacacttgcgttctgaggctgtttctctgtctctaaatgaagacagtcaaactgaatcgtttccaagtccccgtccagcatttaaattcagtgtaagaaggaactcctggctacgctgccttcctaacctggtcaaggaatgttcattctttgtattgactgcagtgtcattgaatttgctgcaaggctttacatcctcctcatgaagaggtgaccttgtatctagagtcccttcgtctctgtctttgatgcagtgatatttctcattgtgagtgattccataagctagaccagcagttgcccatattccatggttgattagttttctagaaaagaagaggacccttcacaatcacagttcttgtttggaaacccaacaggaccttaacatgtattcaaagtgctgataccaaatgcctcttcttacttggtgcccactcctctgcacacaagaacaagtgtttttttcttacaaataaccacttttcagttcattctagtatcacatggtttctagacttctttgcaatttgagtggaactaaactacagttcattgacaggcatcacacagcacgtgtttatagagattaacagaatatctctgccctggtgacattggtagaaggctcattgagatgattttactgtgaacgacgtgaatgccactattctagtaatagtgttcacagctgtatcaatttatggcttattaagtgtagggccaactaaataacacatatttttctacacaactgttgtcaagctgaatttgttccttctaggaaatagtacaacctaatttttcatctaaagatagaggtatacctggtcaaatccttcatagcaagaaagatactactgctagtatgaatcttgacttagaagatgaaagaagctcaaatgttcagttgttccaatcctttgaatttatagctgagggaatggaagtccatcaggagggcatgaagcctgttcaagttcacacagaggatgtggagcctctgatgctcatcgctgtggatccttcccatgcctttatcccccctctgcacacctcacatagtgtcatgagttcctgttctagagctgtggtcccctgaagcaaatctacgggtctcccttctcctgtcttttccttcctttgtgtgtgtgtatgtgcgtgtatgtttgagatcaatgatttctcttttgcctacttttgacttaagataacatttgttttggagctcgacaagcatgactcagcagtgtaacactctttttaattttaattattattattttatggttattcttttgtgattatcaagttgttcttgatgatatctgggcactgtgcaagacttccttcactgcatgggagtatgtgaggttcatttcaattgcacttgtgtttccatcttcttcccttctatcactgactcactcaaagcttgcttttgtttcataaaggatcaaccaacagaaaattgagaaagtcagtccattaatttgtttggccagttttagtcattggttggattcaaaataccccatctattcaacccagatggaaagaactgaccttttctgaagctaaaacatatgcaaaatggacaaagcccatggcttgacctgacctattcctaggtcatggtatcctgatagagcattctccccatccgaccctgaggcacctgaacccagcaacctctttatgcactcacattttcagccttaagggtcttccctaagctccgctttctgagggtaaagcctttaactttcctttgtggacaaattgctcactagctcatcattggggttcagtggacaaggtatccttacatgccatctcttcatgagggcgtgaaggctccgttcgtaaagaactatgatgtggtcatgtaatgggttcactttaagacttgaaaataagtaaagcgaataagttacactataattcatcatctttcatatatagcagtaatgcaataatacaataattactttggtttttgttggtaaattatataaatcattctattcattagagataatgaaaaagtaacacaaacatgatgtgatgtctcccttatgctactgatttactttatttcagtcccgcctcacttcagaatgcaattttttccttgcaggaattacttgtaatggcagtggtagaaccaggggatcaagatatccagcttctgatgcaggaaatccatctctctttattgatagcccagcatcatgcttttatctagagaggcatttatccatctaaacacccctagaaaagctatgtggaaaatgtaaaagcatcaggaagctcaaagttacagccaaggcacagactgaatgctttaaaatcttgtctcatccacagaaatccacaaagattatttccatagatcaaggacatagtaatgctgtttgccctttttacatagtagtaccgtatatttattagctctattgatgaaaataggagagcaactctccttgatattagagaccttggcaaacgtaaagtacttaaaaaatgaatagactgccttccgaatgtgaactcactgactaagcccagtgaaaggagagtatggcatgaaatcagagaatgatgaatggccaggattacgcgcgcgcgcttgtgtgtgtgtgtgtgtgtgtgtgtgtatgtgaaaataaacaatatgattagtgtttattctttttaacaatccacaaattgcctgcttttctctacttttttttttgagatcaagcctcactctgttacccaggctggagtacagtgggtgtgatctcagtgtactgcaacctccgcctcacaggttcaaatgattctcctgcctcagccttgccagtagctgggattacaggtgcccaccaccacgcctggctaatatttatatttttagcggggggttgggggcggggggattcaccatgttggccaggctggtctcgaactcctgacttcaggtgatccgcccacctcagcctcccaaagtgctgggattacaggcatgagccaccttgtctggcctctactttctccagttagaaagtggaagaaactgagcttcaaatgtcttgcttacagctattttggggctctgagttgagatttttgttgtaccatttgtgaagccatccaggtgctgggtctaatcattcctgggcaactgagatacagaaggagccccagctcagatggtgcacgggcacatcataccctgggcattatttttgccctttttctggaagtacgattggaaatgggcagcagatggaccacttcgcattttacccgttcaagcaaggggtatttttcttctaggaagtgggatttccaagcaaaactgccgctttggtagtcacttgccatacttcagtgtccatggaaaaacaactgcgtataggaagagggaagggggacatagcgtgccaactctaactctgatgtctgcaccactcatccataatccatgtcccagtggggaaggtgatattccctggcatctacagacccagcaggcacacggtgggtgagtgggcctggtcacctgcaaccgcagtagaaactctatcccaaggcaaaaggaaattaagaaatccatttgtgaataatattcacaactacaatactgttttgttggatctttcttagtttcttcagttcaaggttgatttgtggcccatgagtctctgatccagacatttgaaaatctctagactcagtgaaagtcatgttaattataaaatcagtaagtacactatacaagagcagctttgagcttggtaggaagacggccttcccaggaaccagagaggagagagccagctttgaccctgcgaggcacatgggagaaaagagttcagttggtttatattctatgaatttactttccccattggtattccgaagtgttcactgaaacacagctgctcctggcactctaatagacatttcccaggacctcatggcagccttatccacagtctccagcctgcagtcacatgtatttttcaggggttcactgttagccctttgagcaaatatttatagagttgtttttaaaaaattactgatgctgtaattaaaaagaacacttaatccaaattacttaatagacgaataaatgagtgaataatcaaaacatttaataccactggtatatataagaaatgaattaatttcaaagtgtggaaaaattatgtgggcttcttatcagtggtattaatctatttttgatacataaaccaccctaagaggttttcctatctatcccaagtgtcattttgcagtattagtttctctaggatgtgttttcattagcctcttagatataaatggctataccactaaaatgtaggaaaaatcccaaatgaaagccctttccctattcaccctgttaagcttcctcttgatggaagctctcttcacccttgaaagctgctaggaggtaatggagggcactgtggccacccagccctggtgcactgagtacctttccttaataaatcaccgttggagtcctatggcaacaacctaacttgataacacatatatctagatgtcttgcttcattgatatgacagtgatttctcttttcatactcaccttgggaatctaagatgttagaagctaataaatcccccacacataaaacatataatgatacattcagagaaagattctctaaactgatttcagcagttcttacatataatagaaacacagacttgcctaccatgattttgttacttttgttgtcatagcctcattcattagtttgacaaatacttgttgcccatctcgagtgttccaggcaccgtgacaaacactggttatgaacagcaaaggagatggaagtagtccctcctctcaaggagtctgtcctctactggggagatacagggaggtatccagcagtacagcctgtctgtctggaaggagcccaccccacatgcagttgaaaaacacagcatggcagatttttcaattttaaaaaaaaatcacgtgctgattttataacagattttaaatatgacctaccagtagattatagttcatcatttttgaaaggcactgttgttaacgatgtagcaccttcccgtcactggtatctcagtagccaccagtcagagcagctcctagcagactccagaatcatgttaatatcttccatccgatcacctctctgaagactgtttgtagataagtgtgtcttaagtgaactttattcgaatgaactcctaccctgtagatgacagtttttgcatgaaccgtaatcagacatagatcttcttagggaacatataatggggaaaataggacttggccagtcatggcagatgttcattgatgtgtgtcatatgaatagatggatgaatagcacaaggtaaagagtggtgtgttttataaggcaggcacatgcagatgttatgaggacttggcaaggctagtagtaactccttaaagaatcatggaagacctcaaaagccaggaggtggtgtgtgagctgggctttaaagtaagcctatggttgtgccatctggaaatttaatttcacaacatcctggaatgtgtttccagtgaatgagtcaatgaaatgacagaagtcagtggacaaagattactgggaattttcctgcaagatgcagcactcagacctgggtttgaacccaaactctctcctacttttaccccaggacttttcccttataagacaatgcatgtgaaacgtatggttataaagctaccccaaagtagaatcttttattattcttcagtaaaacccttcatgggatgagagtttacgaataaattcagagttcatctggaggtgcccggtggatctcttgatgtcctagcttcccaggtacattgccagtttacaggaaaatatgcctttttgaaactgattgaaaacaaattagctgggttttcttggacgatgaatctgtagtttttcaaagatcagaaaattcctgttctccaagaagacaggtgcagaagtgatcatctgaggctgctctccaaggtcctcagtgtatttgcaatttcctcagagtctgtcagccatcacagcatagcctctttcttttttctggatttcttttttattccatgataggtggaataaggcaatctgggcccagtaatgcttgttttttaactcagtgtcatcactatctctcagccagtgttgtgtcccacccaccaatggcccagtgaaaagtgatccagaatcccttctgaatcactgaattatttgcacacaaactcatctatctgatctgtccatcctccatgataaacggaaattagtttcattttctgccctccccttcctcctggaatatctgactcttcaataaatgagaagacagagttatggttcatttactgacttgattttaatatttcggagagcatttaaaacatttatagcgcagcagtcttccttttcataggaaacaaaagtcttctaaaaggcagtctcatttcccgtgtggttagttgaatacagaaaccgtgtagtcagaaggaaggggctgccctgagtcagcccgggctcccggggctggacggagcttgcatttctgagctcccagggcgcccccaagtggcgatgtcaagctccaagttgttctcagtgtgctcaacagcagcgcttttataaggttctttttgttttgttttgctttggctttgctgttgtttgttcggctgcttttatttttgcagttggctgaattcatccgagggttatacaaatcaaaaactgtaagtggagaggatctaccagttgttttgcaaagatagaggtgctatcacggaggatgctgttggtgtggcataggtgggaaagagaagcagtaagaagaaaggagaataaaagagaaatccatgaagctgtaagaagtgtttttttgtcactttttaatgctgatttattcacctggatcaaaataaggaaaaacacacgaggtctaaatcatcaaaataagttgcaagataaggcagcacgcttcatgaggctgtttctcttgctttctgttctcaacaccagttctgtgtaagatgacctgcaacatagactctgcatgtagaatctgttagtggctgacccctgccttatataaacaaggctggtaaatatggagcgaggctcacattcaaacaacaattctatgggctggattaagactcaaagtccctaaacactcatcaaatcatgttgcctctcccatatgcaattccagaaggataatttattttgttaactaataaaagcaatatcatgtgtgctgaaagtattttttcccacatattctgtgtacagaattctatatatgttcctaggggctggaacatttttcctttaactgtgattcttattctgattactagtgttctgaatgcacacttagcctgcgtgctacatggcctgtgcagctctttcctcctgccccgggaagaggatttcaagcctgtcatcttcaactcatagcagccttggtggagtgggttccaaactggctcttatgatgccagctcaaagtcagcctcttgggagtctctttagggcaacagggttttgcctttcaacacaacttaagtataaagtgcagataaacataagagtgttattttaaaataaatttgctaaagcattatttctcttttcccctctccctcctcctctgtccttcctctaccctcctctttcagactcatactcctcctctgtggctttacaaatcctggatagaaaacatctcacaaaacatgttctcttctcttcacatatttaagaggccttcgagcattgacacacatttgcctccagattttctagttgaagaaatgtgcaaaaatcaataaaaagcccaaatacagtggtatttttccccagagttatggacaataacaaataatcaggtgggaaggcttgatgattttctttttagattgtgagctacaggcggccatatgtgttttaaaggttaggtacataaaagaagttttgaggtttcccctctgtaacaactgattggccctctcgggaactctgtgcttaaataaagctgataggattggcctctcttagcatgcttatgccatagatgagcgtctgatgcttagcgacctatcctggtgcaagagccaggcagtggaagaaccaggtgtgcagtgtgtccaacaggaatgcttttggctgtgaaacaattcctggctgaaagggcctaagcccgggggattttatctgggtgggaagaggattctggttttagttcagtacctgcatgctatcagggctcaaggtgtgcatccttgcaaacactggccccttcttctcatgtttgttttttttgttgtttgtttgtttgagacagagtctgtctctgtggccaggctggagtgcagtgagtggtgaaatcctggctcactgcaacctctgactccctggttcaagtgattctcctgcctcagcctcgcgagtagctaggattacagtcatacgccaccaggtccagctaatttttgtatttttagtagagccggggtttcaccatgttggccaggatggtctcgatttcccgacctcgtgatccgcccacctcggcctcccaaagtgctgagattacaggcgtgagccacggcgcctggcctcttctcatggtttcaaaaaggctacagcagctttgagcatcaaatcctcacacaactatgttcaaagacagaaaacaggaggaagtgatgttggcaggccaggggaggggtccctcctctgaccactctctcttaccagagagaaaaataatctttgccacagcctcccagaaaactttttatttctgcttcatcaagcggacacccttaacttgtggatattctatattggcaggtaaataagtgagaagggatatgggtgcagcacgggggcaaccaatgaaaggttggccatacaagcaggtgttccaataagacagaagaatacatgaaccatgctcacaggaaaatttatatagtttcctcttggaaaacaacaacaaaaaccttctggtcttatccaaagcattaattggatgaaaaatgtcaagcttttctcagtgttcggtgcagtacaaacgtaggattatttctaagtggaggagcaatagaagatagcactgtagaactcttccgtcatgccaagagaagttagatatgaccaatacgatgaagggaaatgataaggtgacattatccctgagctaaaagtcaccgaatctgtgacaaggtatgggctagtcaacttgtggagctctccagcccccttctcaatgaagattttaaggcaaactagaattgcattacatttagtgattatttttcctcaaagaccaacgacttcaatgggagatagaagagtctgtggatcacttgcttttattctcttcctatagctgtgaaaattgattcaagaaattgccaacattccactttaatcagggtagaaaccaagagttgggtgtagtttatccattgagatgctctatgcattggcaatgccatcatttaaaaacatcatggagactgtttttagtcatatggacaaatccaagcaggctgccttcccaggaaatcaggagcaacctatgaagttctaggcttgaagttttttgattggtggacttaataaaatgtagatataatcagtagattaaaagtgagtactggctgggcacggtggctcacgtctgtaatcccagcactttgggaggccaaggtgggcgaatcatctgaggtcaggggtttgagaccaacctgaccaacatcgtgaaaccccgtctctaccccagctaaaaatacaaaattagccagctctggtggcgcatgcctgtaattctagctacttgggagtctgaggcaggagaatcacttgaaccgggcaggtggagtttgcagtgagctgagatcatgccattgcactccagcctgggtaaaaagaatgaaactccatctcaaaaaaaaaaaaaaaaaaaaaaaaaaaaaaaaaaaaaaaaaaaaggacctattccaagattttcattaaatgctcagataagtataccacccgaggatcagtattataaccaggtatcttattggaagtcttgtgttttatcttggaatactcatgagttcggtattccatctcctggtatatttggattggataattttatgttatttgataaaattgcctactcaaggaagatagttatcctagggatttgaatatctcaattgggaaactcagcattcattgagaccacaatcaaccatttacatctcattttgagttggacttgaagttgtggatgatatcagagccctgagagagagaaatttaaaaaggaatcctgaaaggcagatgtaaatatcgccttacactgcttcttcttttaccccaagatggctaagaaagccttcaaagtcctttgaaagcattaatttatccaacttttcccacaaagactgaaatgggtctgcatcaatgatgtaatttgggtattgctgggttatacaggagcacaatggtgatgattatgggtgcgctgcagaggactgagttaatggaatcccatcagggactcagagcacaaattcggggcacaaacaggacccacctcatcccgctgcagctgagagtcactgttgttgctgctgtgagtgagggaaaaggctgatcaaattgcaggctcatgtgactggtggatttatttagccaatgggcaatttcggtgtacctctcaagcaaaatataagtaattgttgagagaattacttttttgattaccaaattactatgatttgaaatgcaattagtagtatagacaaacctatttttcccctttatgagaaggaaattgttcggaaatgggtatagtggtgctgataaagttacagtccacagtgaattaaattacccacaagaagcagatacatggtttcatttcagttttattgctcctaatgcaatttgttttcattaatgagaacccacatgtatgcatgaatcagggttttgcactgatacctcctgtgtggggtatttctttttccaggttaggtttcattctccatatttaagatctattgtgtgtatattgatatttgcctataaatattaaagatgcacctgtggttcagagaatatgttaaaattcaagaaaagctaccgatctacctaaagtagcatcaactcgttttttaaatttgtagatatttccatttgtacatggaaatttagagggaatcttaagtgacggtgaaaaataaaatggattttataatgaaccctttaacatgcttgaaaggagtggattcaggagaattaagttcatgaaagtcaggtttgaactttaaatgtttattaactttattgatttttaattaaggacaggatttttttattgcattgaaaaagcaatgagtccaaactagaggcacggaagattttttttatgaaatcagtgtttgaaagtaaggcttttttttctttgcagttctgcagagttcttctgccaaattgcatatgttctggcaagatgggaaaaggctctctgctaaggtacaaaatcagagtatctcagataagccacaacagttgtggtatgatagtttgaccatatctttgcctttgctttgacaattcccttttgatttctaccttcttcctgacatgaaacttaaacatcagttcaagggcgaaacagcatctgaaaatgtcctgcaaagactaaatggactgcattcttttttgattctgaataaagtcttagaaaagataaaaaaaaaaaaaacactccctccctcatttaaatggtttcttttttttattcttgaaaaatccttacccttaggagaatccttgtccaatcctttaaatgtataagctgttatctgagacctgagcaaacatttgagaaatcttccaggtcaccttggtgccgtgaagaaaattgctctagtacattgctctagtgcagtggttctcagacttgtgcatgcatcagaatcatctggagagcttgttaaatgcagcttgcccggccccagccctgagtttcagctggtctgagacagggcccacgaatctgcatttccaacaagtccctgaatgatgctttcgctgttggtccagaaacaactctttgaaagccactgtatgagtagattaaaaatgctacttggtgctgctataataaataaatcacagctttattgtgaacacatttgcaagctagtggtttctaacagtccttttgtagtaagactagcagtgctccaaatgtaccaaaaggagcaagaaattgagaaaacggcatctattcacaaaagtaaagcattatcagtcggataatttgtagtatcagtcttgcttcactttgaggagtactgatgatcatctgcatgaaagcaagttcactgtagttcatgatttcatccttagaacgtagcgcaatgaatggcacatagtcagtgctcaggtgttaactgaataagtgaaatgcctacaagaagcatggacttgaccatgccattttttcatgcattgatttggctttaatgacacaagcatgctgtttaaccaattatcctcagtgacttacccaacaagtatttatttcaagacccacatttctgctggttaactgtgattcagctggtctacactgggctcggctaagagactctgctttgtgctccccaattatctggcttagccccaggctgtgggttgtattgaggtcttctccaagtgtgtttgttctggggccaggctaaagcatcggctgttaatagggacatgtttttgtatggtggatcatcagagtgcagaagccagctagggtatgcaagcagctgcaaggcctctgcctgcatcatgtccacgcacatcccattagtccaagtaagtcacatgaccagtctcaaagtcagggtggcagtaggtgtcaggggacaggttaagatgcttccctgcagggggcatggggtggagagtagtatttgctgaacaacattccagtctgttacagtttacaatatggcaataatggcttattccatttagaactcaaagatgagtgttcaggagctggatatttataggttggaaatgcaatcacatgctccgctatattatgctcttgaaagaagatgctgctactcagactgtcccactgaacatctgaaaagggggtttgtcacgtaaaggaagactctttcctcttccctccttatgtttcacagtcattgtgttgttggaagaagagatggaaagatacactggaatctgcagtacttggacctgggggccaacttgctgggcttttcttattttgttatttctggccgacaagccttctctttcgggggtgaattaagttgtgctcacactcaaccctccctaaatcttagtccagatgcacattttagaaatacactatacccccttcctttatttgtaactgcagtaatttttagtgaagtcaagttttccactctctgtaactgtttctattagcctgcaggagagtaccaatttacgtggcaggatttattgagttgacactggctctgtttgttttgctgtcaggaaaagacgttgcatttgactgaccctatctttatccattttggttttgctgttgctttgaagtcaaagcctgagaatgcctctgggctgatgccaatgtccccagaagacagtgtaagcccttgttccctgtggctcacagtcagttctaaggctgaccataccgcaagcaggacttggtccttcacaaggcatgccagtggtcagcagagagaacagacacaagctttctcttctttctgaatgcaaccatcacctctcctggttacaaaattaaagcactgaagtgcagagactcattcctatcactttaacattgaagggaatcatatttaacttaattcacctgaccctaagaagtgtgtggtttgaaaagggcaaggcgctctaggggcactttggagcagaagtcatatctcgtttaatctaatacagtttgatctatgaactaagacgttttggagaacaacatggttatggtcaaatgatcaccagggacaaacagaaagagaagagagtcttctataccccatgctccaaaaacctaagagccttgggaagcactgtggaaacgatcattgtgtcaccagaaaataggaaatgacaggagttcgtgcctcctccagggtgagaggtgattatttggataatttctgaggcaatgttggtagcacaaggcaagatttgataaatattcagagggcagcaaggaagttttagagaaaataatatatattctacgtatagcctacagatattgatccagagaagggacatgcatgaaggcaagacaacagaagtgaagaaaggtagttagaaagtgggaggagaagagtcgattatggttcaatgtagaaaggcaagatgaagaactaggggagaatcctagaggaaggtggtaaggttgtgagcagccctccgaggggccacagagaaaacatgggatgaggttggcaccagccatttgcgtaggatcaaaagcttgtgcagctcacctggcgataaaccttaacactcgtgttaatcaaccactgtgtttgtgtacatgacactagtgtagttagttgtacgtatgttttgaactgtgtaagatccaagcagtgacacaatggtagggctaaaatgcagagacatgtgctattgggagattgaagcttaactttactgatgttagagaaaggctatttattgggttacaacaaatgattttacataaaacataatttttaagtattaagttgaaaagcccaaattgacccaattcatactttaactctgtttttcaaaagcctgaaatagcaattattgtgtgtgtgtgtatgtgtgtgtgtcctggatatttcctgtttgaaggtgtgtaaaaggtcttactacccagcccctagtggagagttctcttgcaaaaaacaaaaacggaaacaagaaaccaaacatgctttgagagatagagagtgagaaacagattttcagagtggagaatatgccttctatttatgcatttagcattgtgttttctcaagctacccagattttttaaaatttctccccgtttatgagttcaagctgataatatgtaaaagacagtgatgcccactgttttagggaagaccttccttcagagtatgctaacttagccatttcatttcttcaaatattagtatttggaaaagaaaaaacagtcttaaatatggttctgtcctccctcagcacccagagaaaagggaagtcaactacaggatataattctctcagaaataagaaaacctcttagctaataaaaatcatgcttaggctgctaaactcaatggatgtacttttgttattcctacaatgcttagcttgcaggtagaccaaaaatttgccttcattgtcattttaaaaatgactatccaacatattttgcagcatctgcctaatcccaatgacttatatttgttttgtaaatttgttctagggaaaataaacacacacccacacctttgtaataaatagggaagcactaatcatatgaaactagatagaaaaatgggttgggggcatttggtttggagcagcatggaagaattaaactcgacattaaataatttgcaaaatattttcaaaaatattttctcacacttacccaataagtaggaataaaaatctgcttcatcgccacagtgtacttcaggcgttcaaggagaaattgagtagagggaaatattgacatgtttccttccgaaccactacacctattttgaaatgcccattgggtacttttgctcctcttcggggtatctttttccttgtttgtgtgtgtgtgtgtgtgtgtgtggataaggggaggtgaaaggtgattagagacaagaattgaattaattatacatcataaacataacatgccatagcttgccagtctttaaaattgtatcacttcacttattctaacatactaaccactttatttttttatatgtgggaccacagtgtcctcacaccctcgactgcaatgtgtgtatccgtgcttaacacaaatttggatgtgtgggtgcataaacgtgcatgcacatacacacgaggtatagaacatttatttatttatttatttatttagagatggagtcgtgctctgtcgccaggctagaatgcagtggcgcgatctcggctcattgcaacctccgcctcccgggttcaagcaattctcctgtctcagcctcctgagtagctgggactacaggcgccaccatcacacctggctaatttttgtatttttagtggagatggggtttcaccatgttggccaggatggtctcaatctcctcacctcgtgatccacccgcttctgcctcccaaagtgctgggattacaggcgtgagccaccgcgcccggccagaacattctttaaaatgtccctagaagcaccgcgttcagtgtgcaaggtgcaagagtatagccaagcgcttttcaatttgggtaaagggcgctccatctggatcatccttgaggaacatcctcgtgttcatccatgctgtttccagtcctccccagcattccggctcctttcacacctgcatctttcagacgctcgctctttcctgccctccgtttcttctgcttaattgtgagatttgcttcccagcacaaatttttacttcaactctttcccctgttgcttatgagttttatggtgatttcattttataattttaagcagaaatcgcttatcatattttcttagataatttaattgagattttaaactttagttagattacagttacctacaatgccttgagaatatagtttttaaaagtggcacatatgctttatcccaatagtattctatctatgattaatatgcacacatctatcattgtattttgtataaactatattagtatgacatttagtttgtgtaaaaatatgcatgcatatttcatagatagcgtatgtatattacataagtgggaccctaactgcatctatatttagtgaaatgtcaggatcgcgatgctgcggtgaatagcatgagctttctttcatgtccatgttaggagaggcagcttcctcccatcaaaagcacagctggggcagaggagggggttgagagcaaggttttctatctatctaattgtggtgacttttaaagtttagttttatggctctgttgcctctgtcttcaaagtcaaatggagcagctgaagctctccccaccccagacccacctgcctggcctctcccatgcagcaagtttcgcttagctgttgcaatcctggttttacttggttttgtatttgctattttttaaagtgtttttaaactcatgtttcttcatagtaaagggtaactactgtggagtaaacagaagatgagcgtggtacaaattttggttaaaccaaaaactacacactggattgaaagcttggggaagggaggcaggtggaagggactgaaggaggtctcttcccaggagacttgttcaccggcatccagtattctcccccgcagttagggaaacagagggagcatgcagtttcaggcccaggcaggcctctctctgggcttggggcaatgccagggctgggggcgagcctgcagtcagccttgtgagtggcagccgaggctgttattttgaaaccctaagtggaaacaggcatggaaacccggaaggagcagggagccttaggcagtcctgggagatgaagccaacgccctacctccatgtggaaggaggcggcggaatgggcagggtcgggtctcacaggttcccccctctggagttggggtttcccggcccacgttcactctctggatgtgataggtccttcccggccgggaagggctggaaggggcgcgcaaggaggacgtggggacgagacgagagagacgcgtgcccagcaactccagaaggacggagaggagtgcagaagggagccggggaggacgcgggagggccgggaggggaagagaagccaggccgggcctggagcggaggagcggagcccgctggtgcgggtgtccacacaggggcgctggagcgcgccttcctgcggctgggcaggaggcaagcccgagagcgcgcggcgagtggagccatgtcgccctccctcgctctcggcgggcacagtgaggcgcaggctttggaaaagttgcgggcagccggagagccgagcctccgcctgcgttcatgataatgagaatggagtcgcggtcacagccgggctctctgcggggcgcatcgcccgcgaggggcgcctgggcctctgggcgtcctctgccgccccgcgacctttcctgccctcctccggagagaggcgaagggaaggggcggtttcggagggagctgggctgtggagggagggcggcctcttcaccagcgtcgtccgaccaccccgcgccctcctggtggctctcccacgccccattcgcaccccaggtcctcggggtgtctctggtgttgcttcaagttaggcaagaggagctgggggcgcggggagcccggcgccgcagcgcgtgcgtggctggggcgccccggggccggctgcaccttcagtcgccccctggccggcctgcctgcctcgacctccgcatccccttgcaccgtccgctcgcgtgctgcggggcactcgcagcactaccttcggtggggccgcagcaccctgagctcccgggactcccccaccgcccccgcacccacgacccgcgtggtcccagcccctccaccctcttcacgcaccctcgcacccttttgtgcgaccccgtgccctctccgggctgccaacccctgccacccaggtgccagtcccgggcgcggggaggaggccggtggggaagggggcggaggggccggggtggaggaggagctgcgcgaggggcctgggggcggggagcgaggagagcgctcggaatgtgtgccggtctctaggtggtgccaaattctggggcctaggcatttccctcgctttatgtttttggttttttttcttccttcaatctctttgattaggccgtacgtggctgtggcaaggagttggggaaaaaaattataaaaacaggaaagagagaaagcacagccagagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggtgcccgatggcttcgctgtaccagaggttcactggcaagatcaacacctcgaggtccttccccgcgcccccggaggcgagtcacctcctgggcggccaggggcccgaggaggacggcggcgcaggagccaagcccctcggcccgcgggcgcaggcggcggcgccccgggagcgcggcggcggcggcggcggcgcgggtggccggccccggttccagtaccaggcgcggagcgatggtgacgaggaggacgtaagagcttctcgggggcggggggcggcggcgggttctccgggctgagcgcgcagcgagacgcgtcggcaggggaaattttttttggggggggaatcaggcgccctccccccgcccacgactctccgggcgcccccagacaggctccgtggcgccagatcgcggtcaccgcgtcccggagggagcgggtctgtgtctgcagccgcggcggccgggagttggtggctggagagagcggggtttgggtactgcgcctgctgggatctggaattcgccttacgttccctgggtgcgcggatgtctgtttttaacagcatgctgctatggttcctaaggagagaattcgatcggcctgtgcttacgagttggtttattttttatttatttcgtgctccgggaacacagcctcaggcaccttctctccctcccacctgtgtctggaatctctccatcgtgcccctcctctcctactcactctgtcccttgactcaaatgcctctccttcgttcctcttcttacttctcctagacactttttccccccagcggtggtgatggtgattatcctttccggaaaaaaaaaataccaaaatactggcatctgagccccaaccctctgtcccagggcccagctcttttgctgagagccctcaggccgtgtctgtctcccctcccagccctggactagcacctctgccttagaccgtgttcagtgaaaacttctccgagagcacatttcctactcttcatgggggctggaagcctgggtttcaaaggttggatttgcacatcgccctagtaaccaatgactcatgcaggacaggagccggaccttagatggatgcgtttaaccacctcctgtggatccctttcaaggatgcagagggctgctaggacttagaagggaggaaactgtgctttttctttgaggccttcttttcccagggaaaagagaaaaatccccgacaggctctcagagaaacaggtctggcttggctggtacagctcttataacagctaggctgtgttggtttgtagaaattactatgtatgcctttgaggagtttcacaactgctcaacctgggaaccgcaggggtcccaccggcctctcacttagtctaccctgacatacccagggcagtacattgccgggcactgagtaggtggttttggtcattacctctctgcagcctccagccacgctggttccctgtttcgtatttctttagtgcaagagttgtgtttgggtcgagggaggggtgagacattgagtgatttcccagggacaattcctaattgccagatactatgaaatcagtgaggttttgctgttgttattggtagtttttgttttatgaatgaaggatgtggaaactttaatggagatcacaaaactttgtgggagatgtggtttgcacacacacaggtacacaccccctacagccctgcgtcagattttgcatgaggttttgtgattttctcctgcatcgtttccagactcccctggttaaatagtcattcaaaggcatgtccctcactttggtgggccaagccctgagggaaatagacagatccttcagtcatctggttcaagtctttggcaaatggtttaattgggggagggtgaagagttctggaggattaaactaccgagaatcttggggaagacagttaagctgcaatgcaaacaggaaaaatgtactttttaccttaaatctgacttaaaattgttgaattgtggatgtttggaatgagaacaatgtgcagtttttttctcaacaggctctaggtgtcgctaggagaaaggaaaggcaagagctctgaattttatttcagatgatctccatctttttttaaaaaaatcttaacttggagtatacatgtccttctttttattgtgacatgtgtctagaaatgattctcagataaacacaggtgtcctgagaaacaaatcagggatataacatgtacatttgttaatggggttctaaacagcatctctaacttagatgtaagtcctgacatgctttttttttttttttctggaaaatacacaatgtgtgtgggtgggcgtgtattgtgtgtttatatagtgtactcccgatatatatatgcacacatatatacttgcccattatctgcacatatatatctggcacacatctgcaaaatgcattgcacatatgtcctttaaattgtataattaaactcatgacacaggctgaatgttgcatcctttaaaaacaacaacaaacttttatgcactcttcttagaaaagttcctcagaataggaaaagttatgcccccaaatttactaaaagatagatgaacatatcaaaccacttttcctccaggaacaaaagcttcaatttgcttaaagtgtattgaaaaacaaaaacaaaaaaagagattaggtagaaaaactgctttttaggtacagatacttgccaaggcaaggctgaagaatctagagtaatcattttgctacccaaatttaaagctgaggatatgcaatgaattaggaacacattgcattttattacgtgtcttgcaactgctgacaacctcaagacaaaccgaggctttccttttccacatctgcaagcagctgggagcgccgctacttcggtgggagctgtctgaggtgctgaaaccttctcttggcttagcgcaggagaaatctccatcactcttgccttttcagtcctgatcccaaggctggtggctttatcgctgttctctggcttgtcagggaagactgttccaaggtacagaaacagcttcgctgccttggtcactaagatgatggcaagcagcatacctttataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggcaaccaacccatttttttcctccaccttggtttttcattggtataatgtcaacattctgttaatgtgtccttgggatctatcaactttacgatttcttaactagcttccctctacaaatatgtttttatactctattacttttcttctgtttcaactgtaatttaaaattttttaagtttcacatgattttcctgataaatgagaaaaagtctaaatctttcaactgtctatttgatcccattactctcatcaccaataggaccagtgcttggtgtactcacctacagaatagctatggatattgcaggagcatggagagttgcaatgttgccctctcttgatcccagtggcccctacaaagtgggagccatgaggccaggtactgagaagtgcccagtgaatacatgctgctgctgttactaataatattactgtttctaaaggatggccaccctgtttgagggccttggcagcaactgcccagctagtacaagaagcaaaaaagctgactcttgggcaaaacctgaacataaaggcctcccatttcgtggtggttgagagccagcccctcttccccctctggctcttgtgacccccatcacagggtggggagacaccccccgcgaggcggggactgagagccagcccctcttcccccactggcttaggacgcccatcggggatcctaagatccttaggacccacctggaggactgtgggtatgaggtgttcaagaagaaagctcaaatcttccgacggcaggtaccttgcgtgggatttacaatacgacaggggtccgaacgcagctcaggaacagaaagaaagcaggttatttgcaatctaccggagcttaagggcagaaggcaggtgagagaattcttaggagctgtggggttttgtaggctgtggatcccaaacgttgcagtattagccaagcctttgtatgaggtcacaaagggggcggggacccggaacctttgaaatggggatcccgacaacagcaagtctttcattagttataagaaaatcttctggcagccccagccctggggctacccgatctgacaaagccttttccattgtatgcgtcagagagagaaaagatggcagctggacttttaacccaaactgtggggccctggctgaggccggtagcctacgtctctaaacaactagacagggttgctaaagaatggcccccctatttgagggccttggcagcaactgccctgctagtacaagaagcaaataagctgattcttgggcaaaacctgaacataaaggccccccattttgtgatggctgagatccatcccctcttcccccctgactcttgggactcccattgcgggtggagggaggcatcccccatgaggcggggactcagagccaacccctcttcccccccctggctcttgggaccaccatcgcagggggggaggcaatccccgcgaggcggggactgcgaacctccccctttcctcccctggctctttgcacccccatcgcagggggggaggcacccctcgtgatgcggggactgagagcgagcccctcttcccccctttgctcttaggatccccatcgctgggggcggaggcaccccccgcgaggcagggactgagagccagtccctcttccccccctggctctgaggacccccatcgcaggagggggaggcaaccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggacgcaccccccgcgaggcggggactgagagccagaccctcttccccccccagcttaggacccacatcgttgatcctaagatccttaggacccacctggaggactgcgggtggtaggtgtccaagtagaaagttcaaatcttccgacggcaggtaccttacgtgggattactgagagccagtccctcttcccccccggctctgaggaaccccatcacaggagggggaggcaccccccacgacagtggggactgagagctatcccctcttccgcccctggctgttagtacccccatcgcaggtggggaggcaccccctacgagagtggggactgagagctatcccctcttccgcccctggctgttagtacccccatcgcagggtgggggaggcacccccccgcgaggcagggactgagagccagcctctgttcccccactggctcttaggacccccatcgcagaggggggagggaccccccacgaggcggggactgagagccagtccctcttccccctctggctcttaggaaccccatcgcaggagggtgtggcaccccccacgagggtggggactgagagctatcccctcttccgcccctggctgttaatacccccatcgcagggtgggggaggcaccccccgcgaggtagggactgagagcctgcccctgttcccccactggctcttaggacacccatcgcagaggggggaggcaccccccttgaggcggggactgagagccagaccctcttccccccctggcttagggcccccatcgttgatcctaagatccttaggacccacctggaggactgtgggtattaggtgtccaagtagaaagatcaaatcttccgacggcaggtaccttacatgggatttacgatccgacgggtccgaacgcagctcgggaacagaaagaaagcaggttatttgcaatctaccggagcttaagggcagaaggcaggtgagagaattcttaggagctgtggggttttgtagactgtggatcccaaactgcagtatgagcaaagcctttgtatgaggtcacaaagggggcggggacccggaacttttgaaatggggatcccaacaacagcaagtttttcatgagttacaagaaaatcttctgacagccccagccctggggctacccgatctgacaaagccttttccattgtatgcgtcagagagagaaaagatggcagctggacttttaacccaaactgtggggccctggctgaggcccgtagcctacgtctctaaacaactagacagggttgctaaaggatggcccccctatttgacggccttggcagcaactgccctgctagtacaagaagcaaataagctcattcttgggcaaaacctgaacataaagggcccccattttgtgatggctgagatccatcccctcttcccccctggctgttgggacccgcatcgcgggaggggaggcaccccccgcgaggcggggactcagagccaacccctcttccccccctggctcttgggaccaccatcgcagggggggaggcaatcctcccgaggcgggactgcaaacctccacctttcctcccctggctctttgcacccccatcgcagggggggaggcacccctcacgacacggggactgagagcgagcccctcttcccccctttgctcttaggatccccatcgctgggggcggaggcaccccccgcgaggcagggactgagaggcaatccctcttccccccctggctcttaggacccccatcgcaggagggggaggcaccccccgcgaggcagggactgagagccagcccctggttcccccactggctcttaggacccccatcgcagaggggggaggcaccccccgcgaggcggggactgcgagccagaccctcttccccctctggcttaggacctccatcgttgatcctaagatccttaggacccacctggaggactgcgggtgttaggtgtccaagtagaaagttcaaatcttccgacggcaggtaccttacgtgggattactgagagccagtccctcttcccccccctggctctgaggacccccatcgcaggagggggaggcaccccccacgagagtggcgactgagagctatcccctcttccgcccctggctgttagtacccccatcgcagggggggaggcaccccccgcgaggcagggactgagagccagtccctcttccccccctggctcttaggacgcccatcacaggagggggacgcaccccccatgaggcagggactgagagccagcccctgttcccccactggctcttaggacccacatcacagagtggggaggcaccccccacgaggcggggactgagagccagaccctcttcccccactggcataggacccccatcgttgatgttaagatccttaggacccacctggaggactgtgggtattaggtgtccaagtagagagttcaaatcttctgacggcaggtaccttatgtgggatttacgatccgacgggtccgaacgcagctcgggaacagaaagaaagcaggttatttgcaatctaccggaaattaagggcagaaggcaggtgagagaattcttaggagctgtggggttttgtagactgtggatcccaaactgcagtattagccaagcctttgtatgaggtcacaaagggggcggggacccggaacttttgaaatggggatcccaacaacagcaagtttttcatgagttacaagaaaatcttctggcagccccagccctggggctacccgatctgacaaagccttttccattgtatgcgtcagagagagaaaagatggcagctggacttttaacccaaactgtggggccctggctgaggccggtagcctacatctctaaacaactagacagggttgctaaaggatggcccccctattagagggccttggcagcaactgccctgctagtacaagaagcaaataagctgattcttgggcaaaacctgaacataaaggccccccattttgtgatggctgagatccatcccctcttcccccctggctcttgggactcccatcacaggggggggaggcacccgctgcgaggcggggactcagagccaacccctcttccccccctggctcttgggaccaccatcgcagggggggaggcaatccccgcgaggcggggactgcgaacctccccctttcctcccctggctctttgcacccccatcgcagggagggaggcacccctcgcgacgcggggactgagagcgagcccctcttcccccctttgctcttaggatccccatcgctgggggcggaggcaccccccgcgaggcagggactgagaggcaatccctcttccccccctggctctgaggacccccatcgcaggagggggaggcaaccctgcgagggtggggactgagagctatcccctcttccgcccctggctgttggtacccccatcgcagggggggggaggcaccccccgcgaggcagggactgacagccagcccctggttcccccactggctcttaggacccccatcgcagaggggggacgcaccccccgcgaggcggggactgagagccagaccctcatcccccaccggcttaggacccacatcgttgatcctaagatccttaggacccacctggaggactgcgggtgttaggtgtccaagtagaaagttcaaatcttctgacggcaggtaccttacgtgggattactgagagccagtccctcttcccccccggctctgaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcccctcttccgcccctggcttttggtacccccatcgcaggggggggaggcaccctccgctaggcagggactgagagccaacccctggttcccccactggctcttaggacccccatcgcaggagggggaggcaccccccgcgagggtggggactgagagctatcctctcttccgcacctggctgttggtacccccatcgtagggggggggaggcaccctccgcgaggcagggactgagagccaacccctggttcccccactggctcttaggacccccatcgcagaggggggaggcaccccccgcgaggcggggactgcgagccagaccctcttcctcccccagcttaggacccccatcgttgatcctaagatccttaggacccacctggaggactgtgggtgttagttgtccaggtagaaatttcaaatcttccgacggcaggtaccttacgtggaattactgagagccagtccctcttccccccctggctctgaggaaccccatcacaggagggggaggcaccccccacgagagtggggactgagagctatcccctcttccgcccctggctgttagtacccccatcgcagggggggaggcaccccccacgagagtggggactgagagctatccccttttccgcccctggctgttagtacccccatcgcagggttggggaggcacccccccgcgaggcagggactgagagccagcccctattcccccactggctcttaggacccccatcgcagaggggggagggaccccccatgaggcggggactgagagccagtccctcttctccctctggctcttaggaaccccattgcaggagggtgtggcaccccccacgagggtggggactgagagctatcccctcttccgcccctggctgttggtacccccatcgcaagggggggaggcacctcccgcgaggcagggactgagagccattccctcttccccccctggctcttaagacccccatcgcaggagggggaggcaccccccgcgagggtggggactgagagctatcccctcttccgcctctggctgatagtacccccatcgcagtgagggaggcaccccccacgaggcagggactgagagccactccctcttccccctctggcgcttaggacccccatcccagcggggggaggcacctcccgtgaggtggggactgagagccagcccctcttcccccccggcttaggacccccgtcgtggatcctcagatccttaggacccacctggaggactgtggatattaggtgtcctagaagaaagttcaaatcttccgacggcaagtgcatgatagtctgcatgaaaccctaataaaaaagacagtgaaggagaatcatgtcaggagctgatactcctgagtctcgggaagcctccagggacagagcacagctagagcatccaagaatgagaagagccctagagcaaacgcaaagcccaggaagagataattggtttgagaagaaaagggtccaggagttattgcaacccagctagcaagcagagtcctgggctgatcagagtggggaaaagccactgagttgttcaatggtaggacaaacagagccctgctgcagggaggggacactcatctaccctgtacccccatacacctctgtcccgctccccgttcaggctgacaatgtgctcaccacacagcagcacctcctggtcttgattgttggggccctcgcaatcattgcactggcccgtcctgccatctgaccagagctcttccctgctacactcttctgtgagtctccagcaggaccttttgcacatcagcaagctgggcagcgtcaagtgcctggaatccaccccatgccttcccacctctggacatttgctcatggttcaattcatggccattgaacttgtcttggtcagttttctttcagctctcagtgatagacacattccacaatgacctacagagaaaaaaaaggctcaaattgtatagcaaaccactacctctactaaagtaacctattgttctttagaactgaagaccagaggctgtgggacttcagtcttatctgggatgtggtgctgacatgatgttcccaaaactctttctatctgtgtccctaactctcagatttacttttctctgtgggtgttaatctcaagcagatagcaaaggtagtttctgctctaagctcatgaagttttacagttcctaacgagagaggaagacagaggcatgctctctcccagggtctacatgtgaaatctcattcagggtttctggttgatccagcactggtcacatggcccagccacttggagtcagttgtgttgtcagagcctgcaccgcaagcgcgttgcacagacaggaacaggactggccagggagggaatctccattaggacaaagtggttctgcagaccttgcagcgtctcctcctcaaatgccttttccttacaagagcttcctctcaaaatgcacccctcctttcaggtcccattctaatgctgtcacctccaaagcagcaacctcatctacctgtctcaactccctaaatgggtgactgttcctgcatctgaatttccatagcattatcatgacacaccatcctcaccattgtcactatcttacctgtaatcatagctgcttgtgatgagcagcagctggaaggacagacatcactgccacttaaaccagctccaacaaggcagagatgaaatagaccggaagaaggggcaaggctgtgagggccctgggagcaagcagggacacctcccatcactctttgagggccctgggagcaagcagggacacctcccatcactctttgagggccctgggagcaagcagggacacctcccatcactggctgccatacagggtgaaaacaatacagcctgagtgcccacattccattccagcattccccccagtaagaacaaaacaggaagggcccaaggaaaacacaaccagcagtgaagtggagctctgtcctctttgctgtcctcactggccgggtgcacaggccaggccctactgaatactactacctaagcagttacaccatggccttagtacccccgcccccgagagcagaaattgtaagcaaattgtccatcaaggtataatggcaaaaggcacaaattaggaccaggccaatggtataaatacacctgcctgtcacccagcccctagagctccttggagaagcctgagtcctgtgttccacggacatcagtggcatagaggccctgagttggactcaggttttcctcagggactgggttttcctcagggaatggggcaagttcctgggggccaaggatgtcttctgactggcctgcatgagggcttcaggaggtgagttgttttatcctcctaagaagccgccttggtatcccactggccttaagcagtcccagaatacccataatttttcctgttggagaccctcacattcttctaagcctcaccttcatacttctgtgactactgaaatatcagccacggctaggttcagatttgtttttttttttttttacttttttttttttaatttgggacagagtctctctctgttacccaggctggagtgcagtgatacaaactcagctcactgtaacctctgcctctcaggttcaagtgattctcctgcctcagcctcctgagtagctgggattacaggcacacaccagcatgcctggctaatttttgtattcttagtagagatggggtttcactatgttggccaggctggtgttgaactcctggcctcaggtgatctgcctgccttggcctcccaaagtgttgggattataggtgtgagtcactgtgcccagcctcagatttttttacaatgatgccacattgcaattaaatggacttgtccctactgaacagagccctctgctgttgtgccctggagccaggttaacacgcatgtgctctatgccacgaagaacacccaccaagctgaggggccctgcaggcattcacatgggaaactgccattgcgaatggagtgagtgaggcagcttaagtggtgggaggggtgcatgggaaggggctcctgagcaggaccttcaagggtgctagagtttggcagagacaagagtaggagcgaagaaagtgagagtctcatgtaaaagggcaaggtcaccttcctgaacagggaagataaatcatagtggatattgtacaataaagattttattcattcatctatgacaaacttttactcgataccaaccatggcctgatgcaaggctgacaccatgggatacagaaatgcttttgagtgtcagtctggggagagacaggcatgtgagcaaataaatgagctgggtctgtcccatgaagagtctagaatagtgcagttggttagcactctctggtgacagaaaggctgtctatctataccatccaatccaatagccacttgccccatatggctgttgagtgcttggaatgaggcctgtgagattgaggaactcaattttaaattttatttaaccttcatctattttaaatttaaatagccagccacatggggctagtggctaccatattgggcagcacagggctggaggcacatggtaagaaatttatatccaataactaataggaagacacattgattagtttttttaaacctatatattaatcgtttcacaagtactagggcttcaatacatggtactgcataaataaagcagtccttgccttcaagtcaaacacatcaccttatcttattgttatctgagaaaatgcaaaggagcccatgggagcgagaggagggacacttcattcagcttcaagggtgtcagggagagttttctgggagattcgatgattaggatgattcttgaagagttaatgggagataaccttgagaaggaggagaaagctatctcaggtggaggcaacaaccccatggttatcagagaagcagcagcatcagggagaggtcagagtattcagggaggtatgtgggcctggagactcgtgcatgtggggcaaagccattcagaatgaccctcggagatgggcagggcaccatggggcttttgcatggggctcaggcctcagatgactttttttaaggtcatggggagtcatttgaaaattggaagcagacacgtgagatttctgtttttctgcttccatttcagtattttccaaaaagcagtaatgttgctggaaagaaggagagcagtgtaagagtttttgtttgttttattggttgcagtgagatctggctctgccacccaggctgcagtgtagtggtatgatcatagctcactgcaacctcgaactcctgggctcaagcgatcttcctgcctcagcctgtcaagtgcatgccaccacacccactcaaggtttttttttgttttttttttgtttgtttgtttgtttgtttttttgataaagattgagtcttcctatgttgcccagcctggtctcaaactcctgggctcaagcagtcctcccacctcggtctcccaaagtactgggattacaggcatgagtcaccgtgcctggcaagagactcgtttgaagttgaatgaaacgaacagaatttggcaatggcttagttgggaaaggagaggttagcagggaaggggcagctgcagcatgtccttaggggtgtcaacatttgtgctgaacacaggccactgtgggaggaggcatcggcttgacacagcaatcctgtggtggaggtgtttgtattttgaggttattattctattgttgattcttggagtaataagaattgagagattacccagaagcaatgggcagtgtaataagaggagagggctggagaacaagctgggtgactcccatgtttacaggcttctggcctcagggaaggcctggaaaaaaggatgggaagaagatgctgttagaatccaggagaaagctacctctaagaaagcaaaaaaggcaggctcatagcagacaagtaacctgaattgggaaagggcccagtggccccggccttggagggcagctggtgtctgcagggagggtggctttggcaggagcacaggtgtggttgaggctgaggtgaccaaagtcggattaacacgaacccgaggcacgtagcacagggggatgagtgtgggggtttcttccgggctgctgcacaggccctcctcttcccagacagcagctgctgagtgtcaggtggggggataaaggccagaagcagagatgccgctaagcccacaaacaggtgcccacgggatcagcctcggcgcccgggcgggtcttaggtctgaaggacacttggagactagatgttaactgttggaaatttagtaaactgggccaccagaggcttaattcactgctttaaagtctgatgattggaaattaacctatgagaattgtcagattacattgaggtttgatctcccgtgcacttacacaaatgcacacagacacagacacagacacaggcatgcacacacctcttttatgagacagataaaaacccagccacaaagatgtcaatgccacacatctaagagcctgtcccataagtaatgcacagggctccagcccccgtgggaggaagataattggactgtaaaatagtgaagggcacggctgggtcaagagagagtcccctaaaaccaaattccagatgatttccatattctgaatggaaagcctgcataatcattatttttaaaacatatcgacttagaaataaaatatagaagtcaaaaaatcaattaagaggactaattcaatgaagagtgttttctggtggctatttttctttttattaaagtttttaatttttttattttttgggcacctagtatatatttatggggtacataagatgttttgatacaagcatgctctagtgactacttttcaagagttaaactgtggactccagagtctgaaaataaagtataatttttgagaatgttcaaattatagttttaaaagtctttggcccattatttatattttttattcttatttggaattaagcacagtattttgttttttcaaaaatttaaacctgactgagagctaggttgtcatggaccattggttatttatcttcttttgatgatacttcatttaataacaaatcagtgttcctgtgtctgatagagttagatgaattaatcaagtcagtgtttattcctccttcaagtggcatcttcttaaaggtagctttgcaaaatgcccaattatttggacaacttaaaaaaagaactatggggccgtgcgcagtggctcacgtccctaatcccagcactttgggaggccgaggcgggcggatcacgaggttaggagatttcaggccatcttggctaacacagtgaaaccccgtctctactaaaaatgcgaaaaattagccgggtgtgatggtgggcgcctgtagtcccagctactcgggaggctgaggcaggagaatggcgtgaacccgggaggcggagtttgcagtgagccgagattgtgccactgcactccagtctgggcaatagagcgagactccgtctcaaaacaaaacacaacagtttctcatatgcaatgatccccacaccgaggtatcaggtaattgtggactgtgccgttcactgtgtactatcaggaatttaggtaaggcagcaaaagagaagaaagtttccctagagctccataccgaggtatcaggtaattgtggactgtgtcgttcactgtgtacagagattggcagggtgtgagtggcagaaagagcttcttaggcagtcagaccacctggctctgaatcctggctcggtcacaaattaattatatggaagaaaaccttaagcctcggtttgattttctcctttaaaaagtgagacaaataaatgcatttatttctcagaagatagttgtgatgcatctattattttatgacatttttgttcatttttaaaaggtcctgacaaattttaagtgttttatgtgatcagttagatgacatgctaataggcaaaaggcttgcctctaatatacatgctgtcaaattttccatcagcttctatatttgcttctctaagatttttttttcctgaatgacataattaattaatgaggtcatgcaaaattcttaaggaaaatagctaagtcagtttccttcattaaaatccactgtaaacaaagacggccctctgtttaatgcttagtttaacagaaaatttaaattagcacagataattcttcacatcatttggttaattgaaggtatgggaaactgtatttgtagtgttcactcaaaccattcccaataagtgaattacccatgggccaaactctggaaattgccagatgaactgtattatataaagatagtatggcatgaatagctgttctttcatattgcctttaatccatcctctttgaaataatagaggcctgagatacatcagtgttattgagcaggaacgcttgaatataaaaccaatcaagacaacatatagtatgaaatagtagcttatcatgtatgtgcatgcatgctattttatttgttttttgctgataaaggtggaatgatgttatgatgaatttcaccatgaaagactgaaatagagcaaacaaaacgtctcaatcagggtttgccagggttattcctaatgagttattcatactggttgtatttttttgaccattgggatttatttatctgagggctgctggaaaaaggagaaagggaagctacgtcatttgccttctgtgtgccaggcattttctctttctttatccctggaataaccttgtgtgggaggtttcattattctcattttacaaatatggaaactagcttagatgaagagagatggagtgaccctccgaaggccttgcagtcagcaagagttcgaagcggggtgagaattcacgtgtttctgatttctaaagccgtattccttccactgccctggttcacatgttagaatgtcacatctttatccttcagacatagtagctcagtctgcatcagactaagatggggaaaaacttgattcctggaaatttccaaacatacggaaaagtggagggaattaggcgataagccagttgtacccatgacccagctgtataattatcaaggcttcggcaatctcgtttcatccatttcactaccactatgatttgaaacaaatgccagatatcatttttctccgctaaaaacattttattatgttggatcctgtttgtgcccgtattttatactaagccttcacataagttatgttctaggatgtcttcaaatgagagtaaaagaggacaccgttgtcttactgctggggaaaagagagggggctttcttctttcttcaacttccctctgtgatacaagggaaaaatgcagctaaattagtctaaaatctcgatcccttgaaaacagaaaaatcaacagttttaagcaaacaaatacaatccccctagtagctaatcattttcatccacgtgcctggtacacatgctaatgttggagggaaaaaaacagggtgatgtgctttttgagtgtggacaccagagggcagagtgtactgattagagtttcctggcattgcaaaagtgcagtgcggcttggggaggaaaagcagtaggctatgaaacattattccttatgtcaatagaaggaaattattacataagggaaaactggcaagatggaagagcttatatccgcttgcagttctgttcattccccctaaactccatatattatttcaggattttcatgagaaaggctcttctttgaagaatcaattgcttatccatggtgttagtttatatgtttgtatcatgataaacatcctatccagaggtgtgaccttccagaccttgctaacagcatgctgctgctttgcaaagctgcctgcgctttgctgctcacctaaaggaggacttctcaataatagacaggatttgattcctttttgtcatgagaaagctccctgattgtgcatttgtaatgcatgaattgcacagatctccctgctgagaggcttacatcacagagttggctcactgtttccagtatcattcttccagcccaacagtaagcactggcagagagcaggtagctgcctaccctgatattacgggacgtcaataggctcttgcacgcaagtgtggtgtttttcattgcacaccaagggttattaggctgtgctgagtcagatggaaataaaaatagcctggaacctgtgcccgtttgtttgggggacttgtcccagcaccatgctaatgagcccaagggcttgggcttgatgtccctggtggttccatcagagcaacatgaaggaaagcaactgtcggaagccacaggccctcacttaatgtggtttgcagagtggtaagtgatggctcttcccacgggtatggttgtctggcacagagagagccgggggacccacacgctcacgcagttcctgccagcaactgtgagacatgacgactgtgacttagcagaatccagggttcatccaccctcctgtgagtcctcctgctccccgttttgctgccatctcgggccaatatctgcaggtgcagagaccctggagtagctgcacctcagcctcatgtcctctgtggtcccttaattgcccaaaagaaagaatttaaatgtaaagtcgctctgtgcagcgagcatgttccttcgtgccctgggcggcctctctgacagccctgactctggtctgtgacgctgggattgtggctgctttcaggcaccgtcatggccttccatggtcctctgtctgcctttgtctccttccttctgtttaggatgccctttagtgggggaactcctggtccgccttcttctctaaatctgtgctctctaccaaggattttccaagcctgcgcttcctcctgtcgtctcctttgctcctctccgtggctctggctcctgttccgcagcccctggacctatatctgtgatcacacttagtgttttatacatcagttattcacttaagtgtcggccgtgcccaccagcccagaagactcaaggacgagtacttttctatacttacctttacacaagatagggtctcagtactcatcgcgattaatacatgaatgaacttcagcaaaataattgcaatgtgtaaaggccaagatccagaataaaacctttcatttcttagctaaaaatctccccacatccattagttttacatccttggcattaaagatcctaaggagaaattggtattcctgtctggaaaaacttgctgttacttaatgtatttgaaagtaagttatttttaaataaatatgaaaccccatctctactaaaaatacaaaaaattagctgggtctagtgatgggtgcctgtaatcccagctactcgggaggctgaggcaggagaattgcttgaacctgggaggaggaggttgcagtgagctgagattgtgccactgcactccagcctgggcaacaagagtgaaactctgtctctaaaatatatatctatgtatgtatgtatgtatgtatgtatgtatgtatgtatgtaagtatctatctatatatctccatatatacatatagagagagatatatagagatctatatagagatagagagatatatatagatatctatatatatctctctatatatgtatatagatatgtagctatatatagagagaaagagacctggagaacatatatactcaacaggtgcatgtcataaccttcggggaaatagggtgggaaggatgaagatgatattttatgtgatctgtactgtgtgagttgtgagtttctgcatatattaattagtaaaataggtaggagcaaatattatgaaagcattaaaacaccaagactaaccaagacaatcatgaagaggaacatttctgtctaactagatggcaacttattataaagtcttagtaattctgatgactataccccacatggatgcagagacagaataagtaaatcagtggaccaaacagaaacaattggtcatatttacacagttcttgttaccagctgggctgttttaaacaactttccaatataaattcatttaatctttgcagctgtccatgaagtaacgtttataggtctccatttaatgctttaagaaaatagaaaaagaaaggttaaattgctgaaagagtcacataagaggaattggcataagagacacaccggctactccctgggtgtgaagctttatagccacagcagggaggggagtgtcaagaaccagggcagggaggataaagaccccgctgagagttccagctcagtttatgattggtatatgcctttcataagcaagtcactattttcttgaaaagaaatggaaatcaagagatgcatgtgttgtcaaagcgggagaaaatatttgcaaactatgtatctgacacagtactactatccagaatgtacaaggaactcaaacaaatcagcaagaaaaaaacaaataatcccatcaaaaagtgggctaaggacatgaatagaaaattttaaaaagaaggtatacaaatggccaacaaacatatgaaaaaatgctcaacctcagtaatgatcagggaaatgcaaattaaaaccacaatgcaataccaccttcctcctgcacaaatggccataattaaaaaatcaaaaaataatagatgttggcatggatatggtgaaaagggagcacttctacactgcttgtaggaatgtaaactagtataaccactatggaaaacagtgtggagattccttaaagaactaaaagtagatctaccatttgatccagccaccccactactgtgtatctatctacccagcagaagataagtcattatatgaaaaagacacttgcacgcacgcctatagcagtacaactcacaattgcaaaaatatggaaccagcctaaatgttcatcaaccaaggagtagagaaagaaaatgtggtatatatacaccatggaatactactcagccataagaaatgaatgaaataatggcattcacagcaacctggacagagttggagaccattattctaagtgaagtaactcaagaatggaaaaccaagtatcgtatgttctcgcttttaagtgggagctcagctatgagggtgcaaaggcataagaatgatataatggactttggggactcggggggaaggctgggagggggatgaaggataaaagattacacatggggtacagtgtatactgcacaggtgatgggtgaaccgacacctcagaaatcaccactaaagaacttacccatgtaaccccaaaccacctgttcctcaaaaactattgaaataaacataaaataaatttttaaaaaagagatacatgtgttgaaatagacaataactctcaactgtaccagaacctacacctccttattttggcaaattattttaatgctcctttcctaatttaaattaaattcataggtgataaaatgtatatgcatataccactttaaaagtttcaatatataggctaaataaaggaatgaacttataatccagttatctgtccttcagcgtgtcactgctcaggtcctgcttgccaggtggtctgcagctagggcactgacatctgtgatgaagtcagaagcttcttcctatgtgtaaagagtaaaactgggtttaaaatatttttttttaaaaaaaaggctgggcgcagtgcctcacacctataatcccagcgctttgggaggccaaggcaggtggatcgcctgaggtcaggagttcaagaccagcctcgccaaaacggtgaacccctgtccctactaaaaatacaaaaattagccatgcacagtggcgggtgcctgtaatcccagctactcgggaggctgaggcaggagaatctcttgaacctgggaggcggaggttgcagtgagccgagattgtggcaatgcactccagcctgggtgacgagggcaaaactccataacaaaaataaataataaatttttaaaaagcagaccagaaatagttccatataaaaaatataggaaaagggaagagcagataatacagaagaaccttagaataaagcctgagattaagtaataatagattagttttattttgaaaatgaaaagaaaatggggacacactccatttgaaatacaggatgcgtaccaaggtggatcacagattgagaggagaaaatgtgtgagattctccactgatagccaggtgtggcttcttctttttaagcatggcgtgaaacaaattatgacatggatgatgagggcatgaagtgtccctgggatcctaccacctgacaaggtgtaccctcagtctccaatgcttaataaatgccttgtaaactgtaacctctgatacttaatgaggaatacagcgctttgaaacagaaaccgaaataggtctctagagaagttgtatgataagatcctgggggcagtgtcagaaaaggaccgaaaaaccacagattcctccctccaggaaataatttcaatacttaaagtttaccatgtagatttcttgttctggtgctataattgtgaagcatataggaaacactataaaatgttttaaaacaatacttttgataaactttattaagacctctatgtttcatgtgtttgcactaaaaataatgtttgcttctaagaatgttcctatttgactaaggtgatttaaaatgcctttgcattgttgcactgtttgtgtagtgattgtaactctgtactaaagccaattaactttgtagttggatgggttataaaatactcactagacacagtactccatagacaccatattcaataatagacacaatgtgtagaatgaagaagccagcgtccacctctgcaacgagcttgtcctgaatccctggaccctttatttttcatcccataaaaactttcagtatcattatgtactgaagtactccttatttatagttctgtggatttattccaacgagtctgttgaaaactgggatgtggggcacctacacttctcaccgtgcaggatctctacccattgcagggtgtccagccccctggcctctaccccaaatgccagtgaagtctaggattcattgtgacaactgaaaaactctcctcatttcaaaaatgcttcctaggaggtagaatggccctgttgagaaccttaaatagattatagattttatttattattattattatttttttttttttgagacagagtctcactctgtcaccaggctagagtgcagtggtgtgatctgagctcactgcaacctccgcctcccgggttcaagcaattctcctgcctcagcctctcgagtagctgagactacaggcacgcatcaccatgcccagctaatttttgtatttttagtagagatggggtttcaccttgttggccaggatggtctcgatctcttgacctcatgatctgccctcctcggcctcccaaagtgtcgggattacaggcatgagctactgctcccggccaatagattatagatataatttttctgttattatttctttcacaaaaccctggctgtacaagtatcctctgtaaacttagatatttccgacagtgtgtctacttccttccttcatgatctcaactctctgtaaattacatgtgaatgcattcaggactgtattttatatatcatctctttcatgttttgatttgctttttccaagcagacattaagtgtgctgaaggtagttgtgttgtcatctgctttcattgaatccttcagaaattttagcaccacaatgagattctgaaaaaagcacagaaaaggggcttaatatagaatgtttaaagaatatttgttttctcaatttatattacgactttcaaacttcagtgcatatgtacacacacacacacacacacacacacacacacacacaccattttaaggcattgctagactcacatatatctttcaccttgaagatgaagcaagattccaaaatgtcagaaaatcttgaaagtgtcttagatacgagcaatatggggagagagccagcaactgagttattcccaagctcatttagtgacaaagttgtgggttggttaggcttgttagagctcaacaaagcacttagtgaaggaaatatgaaaattagaaaccactgtaggatataaattaagactatttggaggctagaaagatttggggattttttttgttgttgttaaaatatctagccaactcctgaaaaataatgagtggttgccatagcaactgtgttttcgcttgacacacgaaagaacatgaaaagcattggaatcaaggaaagccacctggttttagactttaattttggagaaacaaattcatccaaaatgatttataaaacaaaccctattttattttccttccaaaatgattgtagattttttaaatttttttaaattcaaaacattgagggtatctcaaaggaagtgaaaatacattcttttccaaaaaaaaaaaaaaaaaaaaaaaatacctgggccgggtgtggtggctcacgcctgtaatcctagcactttgggaggccgaggtgggtgtatcacgcggtcaggagatggagaccatcctggccaacatggtgaaaccctgtctctactaaaaatacaaaaattagccaggctttgtggtgcatgcccacagtgagctgagatcgcaccactgtactccatcctgggggacagagctagactccatctcaaaaacgaaagtgcctggtcgtctttccacacaactccgtttccactcccataaaatgctacgttagctgttttgagggtagatgcccttagactgccaactcacaaagttttattgggcacctgttacctgttcagcagagatttgtaaaaaaagacacatcaggtggcctttgcttgcaagaaatcagcctttggaacctgtggagaaaagttaagtactgcgtactgcgcaaatgaagggtgggagctattgaagggaagagactcaccccgaaaacccaagaatggtcaaacgagaggcaaggtggagcctgcagttttcactggaaggattctagagtgagtgattctggggacctagagatgggggataacgggtgaaaggaacaagcacggcccctttgaggtggaaaacagactggtgggccagggttgggagggtgtgctggggaagtgttgtgggcagaggctggaaaatgaaattgggctggggttaggagacaggtgaccgtggaagactgctctgacaatcagagtctggactttgctcctctgcaggatccctgatgcccagatggacccttcgatgttcctggcccacctgcgctacctattcttgccccgctctgctctagtatttacaactgcacgatggcacagttggtctctgggacttagaatttgtgttgcaaacacaagacctggagaatggacctggtctgtgatatagtgtgtcagtcagggacctggagaaacagaaggggatcccaaataagaagacttgaaggaagtttaagaaaggcaccaaatacaatttgaaacttgtgggctgggaagccacacgagatagcgcaggctgggggatgtgcaggagctgtcatcagaagccggaagtggaacatgttatgaaaaaggtcacttttcataacactttgcatggagaaggagtacaagggaagtcaagaggacccacagtgggaagtgggctgtgaatactctgatcctacctcatttactgccagtgcatcccttggcctaagtgaagtaggagcttgggagaagattggccgttgactctaatcctgctcccaggttcctacttaatcagcatccaagatcaaggtgtggagttgacagtgacatctcggacttcaatccaccatgttgacttctgattaaccccagtcctgggaatacctccaagaattctactttatttacttctcttatgtaagaatgtttaactcaccatggatcctgcccttagaccaaagcgaccttgatgttattgcacaaattacaggctatgacacatataccattcctgcctgtgctagaggattgcctttaattgcttgctggagcacatatgcttttccctatggtagataagccttgggtctgggagtaagagtgcagagatctacctgtcttggtgccacccaaggtcatacctccgtctgtaagttcccctttcatggaacacaaggtaaacctcacaaagtataaggcagatcttttcccatttcctgcatgtcttctcaatacctgtgattgaaacatgcagtggaaatatccatgcccgtcttgatggatgaagctaactggctggtaggtcgaagccagttcgaggaacaggctaggaggtctgcatggaacctgggattggccatcccctcatgagggctctaatgggaagatgatgccttgggtgtgcctggatgctgagaaaacatgagatgtgtattaccttctgctctctgtatgtaaaacagctgaagctaaatcccttgagatgtttctacatccatctatacctagatcttggaaattttgcaaataagcagttgtcagaattttgagctatggcttagggtattaaaaaatagaaagacaagggaagagggtgttgatggaggcttgagccacttagcatgacctagcccctgatcagctgtggttagtccaaatgagccagtatgctggggcagagagcaggatggagtagcaaaggccctgtagtgaggccctctgtgggggatgagtgtgcttggtagcagtttgaagcattgtgcctctctttcctatgcactgtgatcagtgcacaggaatgtagaaagggccaagcctttcaacaccttagactctgatgcctccagggtggattcactgtgccatggaaaaccacataacatcatcctattagcgtacttttgagagtagatgtgctattaatgatgctaaaacaacagacatacactaccagaatgctcctagcaaaatgaggacatgtagtcaccctttcctctgctccctccccaccacctgtgccattagaagctggaggagggagcggtcactgtggcatggagtaggctgggcaatgaaggcttctaggaaaggcgggccttggttcatgatccgtggtgggattcatgtgggtaggagagaaaatcaagggacgtcaagagcgtggtaatagcttgttactacctggggagaaacatatctgctagagttgccatttagagacatgtcaaaacctccagaaagtgtgtttcaatgccaagtgctaattgtaaaagggaacgtgtctttctgcagttctagtttgttatagaaagggacagctcttgacgttagcaaataaggttgtatgttatggatcctgtggcaactgagtgtatgtgacggaaaatggatgtttactttaaggtcattactgaagactttctggagccacctctttcttggggacgtctccctactgattcatattagaaatcaacttgagtgacctttctcttcaaaacatcagagactgccttggactgtgtggtctgcttggaggacttcaaccctcttagaaccttactctgcatgtgaacacagcagcacaggggcagcgggttccatcgtctacgggagatggtgctcaagggttggagccagtccccctagagagtcacatagcatttggccctcgaccatggctgaataaatgaatgaataaaccttatttaatatatactttcacctgcctgagttgtagaactctgcagaagtccttttatatctcttctacattcatcttcagagccattgtatcataggggttgttttgttattctccatacatcctaatttatagaggagaaaacgaaatccagggaaagctggaaaattgatccagggtcaaacactgaacttatggagaggatggagaggaaagcgtggcttttggagtaatactgctgagagtcaaatcccagttattgcagtgaggagtagcaagaagtcacctaatttcaacaacacaatcatttcaggaatggaaagaacacccccagttccattaaacgacatgaagtacagaaagtcctggctcacagaaggggcccactaagcattagttgccattcctttcttaggtaaccaccgcctgtggaccctcaccccttcctccactgtcagaggcagcataatggctcagtttgcatttcaaggctgatagaatcaagtttgctaatgctggtcctgctgccacctagaactcccttaatgaaagtcagcctccacaaaccttgaggagtattaaaggacagagccctgtgaaggatggtgctgtgtgtgcctatcttttctttttcttttttttttttttttttttgagatggagtctcactctgtcacccaggctggagtgcagtggtgtgatctcagctcactgcaagctctgtcttctgggttcacaccattctcctgcctcagcctcccaagtagctgggactgcaggcgcccgccaccatgcccggctaattttttgtattttttagtagagacggggtttcgctgtgttagccaggatggtctcgatctcctgacctcgtgatccgcccacctcgacctcccaaagtgctgggattacaggcgtgagccaccgtgcctggcctgtgcctatcgtttaactgactagttggattagtgaggagtcggttagttgttgtgcttctttgcagtgcactgggctgctacatggacctgattttgactacctgttctaagggatgaggaagccctccttgcagaagcccatggaagccctccttgcagaagaaatatcccagccactcaggttggcagactctgtgcagaatacccagtgtctttcctcctcttatttatctctcttcaggtaccaggaagtgaaagaggcctatatacatggaagttctgaaggagaatagcgttgccatcctccctacccacctctgagtctctggttcctggtcacccaagcctccatcatgccctcttcccttctcttccttttattttttaataccctaagccacagctcaaaatgctgagcaccacttctcttcagcatgactgaggtctaggtatagatgggtatggggacagctctagggacttagcttcagctgtttcaaataaaggaaaaagcagagaacagggatctcatgttttctcaccagccatgcatgcccaaggcatcttcctatgagagccctgaggagggaacggccaatcccaggttccatgcagtgcctccagcctgttcctgggacaggctccaatctcttggtgcagttagcttcatgcattaagacaggcatggatatttccatgttcttcctgaatcacaggtattgagaggaagtgtgggaaatgggagaacagctgccttatgaatcatgaggttcacctaaaccttgggggctagaattgagatggagcagtgttctgaggggtcccaagaagcctagtataactcataagatgcttgggagtttaaatatgcttttctgtgcagagtctaccatctaagtctctctggtttgaagttggagaaactgaatttgtcattcagctagaaaacatactggaggagagattttaactcatgcctcagaacaaagctcagggctttctgaagcaccagagggtgccaaaggagtcagagcttgggttctgcccattgagaagaatgaagagggatgctggtttcagtttagcaggaggaaaatggtaaaaataacattgaaaagaacaaatagacttacaagggttctcaagatttatctgcaagtgatattttctaaggagactgcgtgtgtcccccaaactccattttcatcatgtcacatttttctcaaaagcatttctataattctagcatgagaagggaagccttggtctaaatgttcatgagcggaaccaagccgcctttccagcctcatcctgcaagcacatactccctggctgcaggtaggtcccctggtagtgtgtagatgccagcatttctgttttaatggtacatggagagaggcgatctaacctaacaacaaattgatgatctagcttgaaaaaaataccaactgccatttctatcaccgtaatttcaaaagcagaaggacattttaacatcaaaaagtgggaaaaacattttcagaacaaatatcatggctccttaattttaaaaagatgccttgggtgcgttggctcacgcctgtaatcccagcactttgggaggccgaggcgggaggatcatgaggtcaggagatcgagaccatcctggctaacatggtgaaaccccatctctactaaaaatacaaaaaaattagccgggcatggtggtgggcgcctggagtcccagctacttgggaggctgaggcaggagaatggtgtgaacccgggaggcagagcttgcagtgagctgagatcgcaccactgcactccagcctgggcgacagagcgagactccgtctcaaaaaaaaaaaaaaaaaaaaaacaggtgcctttataaaaccttgttgtatctctttttcttttgttttaatttaccacaaattcagaagagcttcattatccctagagtaagaaagggaaagaataaagaaaaaaaaagagcttctttaaagaccagcaatccgtggacaggcatttagcagttactgacttagcctacacactgggctgatatagtttctccatctggaatgtccttttatctttcattttatccaattctcaacttcttttccatcccaaagaatatcccatcgccactctcaagcttttccggacattctgcagtaatatctacctcatctgaactgaaaactctcttgcctcttgtactcaattggcctttaccgttcactgtcttctgacatctcttaaatagtgatgagtcattaatgcatctcgccaactagacagtaagcattttatacctctttttaatgtctattattttcagaaaatatgtgatacctaataagtaagtttttaaagtttgctgaacgaacacagtaagttctttgttgtactccttgttttctggaactgtgatgttgtttatgtcgagtcccagaagttaaggcagaagggaattgagaaactgaccctgaaattatgtcataaaaaactgagagttaaaaaagaagccatggctttctattgcaactttaactttcctagtatgcttagtacttattttttatttttatttatttattttttgagatggagtctcatactgtcacccaggctggaatgcaatggcacgatcttggctcactgcaacctctgccttccaggttcaagcggttcttctgcctcagcctcccaagtagctgggataacaggcgctcaccatcatgcctggctaatttttcgtatatttagcaagacagggtttcaccatgttggccaggctcgtcttgaactcctgacctcgtgatctgcctgccttggcctcccaaagtgctgagattacaggcgtgagccaccgcacccagccagcatttatttctaagccaaatcaaaatatagacctttgatgaaggtgttaagaaaacattgcattgtcctggttatttagagatagagacataaattctctatgattatttctcccaaagatcttggaatccaatggatctgagtcaggtcaagatgaatgaatacaaatatgagaagggcatagctcatcagaaattcagagaccctgggtgagcagggttaggcaacttggagaaactttctagacacaggagccatagcactgtaactaaagaaggaggaaaacacagcatgccgagcagggtatagaggctgcaggtgtgtttttccttggctttcatgctgtgctggccctgacacaggactgactttacccataaagaaagtggcagcagcaggaagggcactgtggtgagccctggtgaatccacatggcacttggaccaacccctcagacacaacccctttctcattctgttccatctgctgccctacacgatgttccatttcagggctcgtttctgagcatggaccagttgctaggcacagttctgcagatatacagtgagcagaaacaaccacagagcttactcttttttttttttttttgagatggagtctcgctctgtcacccaggctggagtgcagtggcacaatctcggctcactgcaacctctgcctcccagattcaagcgattctcctgcctcagcctcctgagtagctggcattacaggggcccatcaccacgcccggctaatttttatatttttagtagagacagggtttcaccatgttggccaggatggtctcgaactcctgacctcatgatccacctgccttggcctcctaaagtagagcctacttgtatattgctaagggcccagtgaagaagccagggatctgttaaatatctcacccacacatataacattacacatctgaggactgttgtcaaatgaaatgatgtggttcagggagaccaatgagtgggatgtggctgctgagaatgaggtgcagggtgatgttacatatttttttcccaagaaagggatgtgtaggctgacagctaaagtgtcagtaggtgctcactagtttggaacagaagagaacattgttcatgcaaaggaacagcccgaatgaggctgtgggacaggagggagtgtcacggggctgacagaatgcccacttggctggcacacaaggaagggaaaggagtggtgtgagatgaagctgagcaggtgtcagcaccaacctcttgggactttgcagagtatggcacagattttagcttcattataagagtagcaggaaggcactgaagagtttaaattggcaagtaatgggagctgaactgtgcttttcaaagactactctgtctgctctctacagctgaagaaggactgaatatgggttggagggagagagtgagagcaagcgtagctgggagcaaacatggagtgtaagagcagaggagagaattagccgcaggccagggaccttggaaggacacttctcactaaaagccacactcagctagagagcctttttaacagtgagtgattgttcttctctggtgtttctctctgtccgtccctaatccaagccaggagagaatgaaggctcttagtttaaaaggtcctctggtcctttgctgccccgttcttgcttttctagccagacatggttctctgaggatttgttaaattttatagcccagtggtcaagtaaacatggggtggtactcaaagaaactcacaggtatttattatccaaagctactgcatttggggattattaaatacagacatatagacacatatgtatgcaaggtcattggagtgacatcccatcctgagaacaggggccaccttctacaaatgccaaaaatgcacttcgcacagtgttggaaatttcatcgggtgttcactgaatgcacagacctgctgcagagcctggttcttgtgtctcttgtcttcctgggtgtgctgggatggaggacagattcttatgtccctcattggaatctaccctctcagccagtcttgtgaccacacttttggagtgatggagtgatgggaagcccctcgtggcacagcacctgccccagcaccattggctgaaacggaaacaaccatccacttggcctagcagagtccttgactatcttttagggctttgctctgggaggggctgtgctctctgcctgcctaatatccccacttctggcccagtggggcttgggctgcagtagctgcattccattctggcccatcacgtggcaacaccaaccacgatgcctgccgttttccctgagatgttctgtgccctctcttctgagacactggtggctttctgagaactgctgtatggtgaactccatcttcaagggttattggcttccaaacaccatgacttgcgggagccccgttccctgctcatcagtgtccatgcaattcaggcaactctccccagctatgctagttacttccttcatctaaaccctgtttggaagccctgaagttcctgcctggggaagtcaagtaaaaatgggaggtatgggacttgatagcagcagatgtgcaaaggtcttacaggttacagttgagtctcagtgtgagatgggtcactgggggatgtggcccctgggcagctagtgctatggagtctgtagaatagaggcacagtgatgaccagttatctctggagcactgtgctcagttctaggagacacatttttaagagaaactcgtgctttcctgaggaggtctgggtctgtgctctctgatatacggtagcctctaaccacctgtggatatttaaattttatgtaattaaaattaatgaaaatttaaaacagttgctctggcactggccacatttcagatgaactggagccacatgtggctccggctggagtgtcaggcagcacagtggagagcatgccctgtcctctggaaggatgtggctcagagcacgtccagcccagaagtcacagagccaggacctcatggagtgagaagtagttgaaaacactaaagttgtgtaccctacaaaattgtcctcagacaattcagaatctatgtcacagaagcagaattggatttctcaagagtgactcacaacagcataacttggattaactgaagggatgtaaagagaaggttttagctcaatgcaagtccaacatttccatcagaagtgttcaaaacgtggaatgcgagtctccaggaattgtgatttttttctttcgtttaagacgttcaaatagagactgctgtccaattattgccaatgctagggagggcatttctgcctcagatggaggtagtgaggtgtcagcaaagaatgtggattttagaactaggtagatttaacccaagtcctggttctatcattttctaacttaatggctttgctcaactcaccacacccctccgttctccccagtaaagtgaggacaatactaattgtctcacaatactgtgttgggtgttaaatgagaccacaaagtaaagtatcaaaggcagtgcctgtcccagagcaggtgacttgcactaatcagaggctcaccctgccttgctgctccacacacacgactgactgacaacatccgtgacccacaacatccacagctcattcccacggcagtcctcacgcaggcaccaaaactctaccccactcatgaaatcgacgtgaaatgcaaggaaatcagaatgtggttatctgaggtatcgactttaatcttctctggtttatttttttaaataaattagttacagagcgagactttaatcattatcagtagcagatttcactagcacaattatcaagtgtcaaaaccccaaaggtgagaatcaccgttcttggagcatcctaagccctgtctacctttagaggttccaatgctggcatagggttcaagaccatatgttttattatgaggaattcaagtgagaccagactgttttgttgtaaatactataagaaagacaacatcctttcttctcctccatttctatgcctgtgaagatgtgatgagcaagccttggaagcctcagttcctcagactcttccaggcatggggccatggaacttggcaaaagcgggtgctgtgtggatctcagtctctggagccattcgttgggtcgtgagcagcaaagtagccttcatctttcccagtcttcacacttcgaggaccctcactgctggtggggagggggtttctgctctaggctgtggtaatgctatcccccgacctgcaaattcacacaatgagccaactggccacatgctccaaggagctaagatgctgttggtccacaaacaaaggttcaggttctgtgtagcttaggatccggttgctaattggcttgaaacatttaaatcctcttgcatttagttgaatatgtggatatgcctattgagaagtatgttatgaaatctagggtttgtattcccatccgtaacaggaagaataaaaccttgaaaaatgtttcattttaaatacagaccccttgtgtatcaaaaagtatatttttttgggaatacaaagccaccaccaccaccaccaccattgcccatagaggcgcctgcagaggctggacttgctgcttctggtccgttgagctgagaagcacagaggttcagtgggttgttgagggcaccagggaccccaggtggaactggtaagaaaagctgaatccaatccttggcttttactcaccttgtttaaattactgtccttaagctttttccatattagcctggagccataaatagtttgtgtggctactttcaaaattcaattctgggccgtttgcggtggctcatgcctgtaatcccagcactttgggaggccgaggcgggcggatcacaaagtcaggagatcgagaccatcctggctaacacagtgaaaccccgtctctactaaaaatacaaaaaaattagccaggcgtggtggcgggtgcctgtagtcccagctactcgggaggctgaggcaggagaatggtgtgaacccaggaggtggagcttgcagtgagccgagactgcgccactgcactccagcttgggcaacagagcaagactccttctcaaaaaaaaaaaaaaatcaattctgtgcaattcagtcgtatttattgggaagcctttaggttcccagaagaactgagccaaccttgaagggaacaggaaagaaacagagcctgtgatcagtgggcactcacagcaaataggaatcctccgcctcccctgcttagaaacctccagcaattcctcaggggtgcaggtagaatctcagtccagcagccaagggcttacgtattttgagcggtctatggctttctgttgagcagacttatagcttctcatagctgggcatatttctatttcctgggttatctgaatgcatttcttgtaaccctggcagaagaaaagtttctatcagccctccttgtaggaagaaaatgtgttccctagtttgtaggcagcagagagcctgctgtgttagttgtgtcccgtcagaagcatttgagaaagtctctcgcggtataacaatggcagttttttgcttgagggacagagagagagcagaagctggtgaatctgacaggcaagggtccctaagagaaaggataaggtccctaagaaagggccccctgccctgccttcctcacctcctcttccccccctcaccacgtggcctcaggagatagggcggtgtcactgcctctgctgaccctcccgatgtaccagatgaagagaccgggtcagtaacgcaaggagttgatgtggacatccactgcccagcattttgttcatcgtgcagctttataaactgtccaaagcaaggttcagaagaggcaggattttgcaaaactctcacatcagttccatctaggacgtgtggacatcacagtgattgggatgatgggctggctgacccttggtggttctcaacaatttccaggatgttgcatttatttatccatgacatgacatcaggggtgggagctgtgcttatgcagaaaggggttctcacagactggaccatctgcctacctgctctcccacctgtgtattgtatctgtttatttaggtggaattttaaatttagaaaacagttgcaaaaatactatgacctgtttatatcctttactcagatgaccaattgtttacattttgctccacttactttattattttctctctttctgtatttaccaataaaaagagcattttcttacagaggcacaggaccgtgaccagaatcaggacattcacagttggcacagtatcggcgtctaacctggcatcaacattccagtttcacctgctccctggcacactgtggaccactgccaccttggtctgggatccacccaggcctccagtgtgtgtagttgctctgtctccttaatttcctttcaactagaatatttcttccctctttctttgcctgttatggcctttacatttttcagaacagaacaggttttctgtacagtgcccatcactatgatttgtttgatgtttcctcataattagaattttggccagaatcctagagaagtgatgttttgtccttgccatgcatcctatcaagaggcacgtgatatcagtgtgtcctgctggcgatggtcattttgatctcttgtttaaggtggcatctgtaaggttttcccaccgtaggttgctctatttcctttgaaatgaacaagtaattgtggggcgattttttcggactatattcatatcttttgactcatcaaattttcacctcctagtttgggcatgcattgatgattcttacccgagtcaagtattattacaatggttgtcagatggcaatcttctaatttcatttctccgtctgcgcccatcagttggcattctacaaaaatatggagccgtcgtgagcttgcgtctccttgtgcaagagctgtggctatgctgagcttctccacatatttccaactttagtacatgggcaggtgaggcaagcaccactcttaccttcgaacaccacacacacacaccacacacacatatcacataatacacaccccacataccactcacacagcataacacaccacataacacacatcctacatatgacatcatacatcatacacaccacacacacaccaaatacaccacatgccacacaacttacataccacatcatacacatcatacacacgacacacagcacataacacaccacatgccatacatcctacatacatcatacacaccatacacacacatcaaataccacaccacatgccacacaacctacacaccacatcatacacagcatacacatgcatgacacatagcacataacacaccacatgccacacaacctacataccacatcctacacaccacacacaccccataacataccacatcacataccacacacaccatataccacatcatatacaccacacacaaaccacacacacaaatgcaaacaccacatacaccatacatacccacacacacaaacactgtataccatacaccacactgtacacaccacaaacacacacacaccataccccacacacacaccatacacacacacacacacacaccatacacacacacacacacacacataaaaaaaaacttctgttgaggctgtgcccccaccacttggagccactacatctccctacctcaacttctttccacttggtagtcctgtcttctgaagttagtaaatgcaggcgtgaggcagggaggcgctttggctgattggcggaaccctgggatgagccacagcatggctgtgtggcacgtgtggtgtgggtgtgggtagggggatcccgccgtgcttccttcccaccctgagtcccgtgtgtgccccttacagtgtgtttcctattaaagttcctttcatgtttgggccaagggtgtttcctttaattcctgctagcataaaagaatgaggttttctgcagcaatttctaagtctgaaaagggaggctctggggtaaaaatgttgaacaattaaaatgattagaaattatctatataaaatacaggtatacaaaatatgtatattgaatcctagctagacagacggtatccccgggagaactcctccttgaggaatgggccatttgcttcataatagatgcgagatcatcctcgggccagttagcatgcacagtttcccgggatgctttgcgatacaaattcataaacattgattgaaaggtcaggggacgttcccatcaacacgcggctctgtcggattgttcaagggaaagttagcactgttgcatgcaggcagttgagttcttagggaagagtgctggccctggtggagttttccatgtctgtgtgatttggtgtggtgtgatatagtcaatgggacttggttcggcgcagggagagctgcatgtttctgctcatgttatctggaaataaggattcgggctctgtgtgctgaattatgtttgcggcgatctcacagttgtgaagaagaggcatggctgggaggcatgttcagagctggagagggtataaaattctcatttcttaccttctctgagggaaggagtgtggagtggcagatttccagtctctgggtcttatatcagtgtcgttctctgggaccagcactgtccccatatgggtaccactgggacgtgtagttgacctctgacgtgcacggcagatgcacggacaggcagggtggtgctgggtgagcattagccgtgtgcagctggtgagcctatgccttcttgttggcaggcctcgctgctgagagtaagttggtgaggacccatgcacgtaggttctcacatgtttccaaaggtcccttcctgcctcactggtgagcctttctcccaaatgagaactcctcgctcttgcctccctttctactttctacatcttcctgggacttcctggccatctcctttctgcatgcatgctgcaggaatttccactccagggagggagctctcagtatctgcacagcccaggtgcaggacatgtgctgcccaggctgggttgctgtctgttgtttcaccctgcacagtgaagagaatggggggttaatgtgtcaggcatggcatgcgtgatttagaaccattcatgcctccaagtatttgaggcagctcctgggatccacatctgtgagcaaggaaactgaggcctggcttaaatcacacgtccaagaccagagttaggaacagggcacctgcctggacccaggttcacacctgtaagcatgtcgtgggtgtgggatatgccttagctctctgagcacgtggcagaaatttggggatctatcacccactaccgtaactgtgacaacgtctccacaggaggagcggcaaagtctaaattaaaagaacgtttcccgcagggggcgctcttttttggatctctctgcttggagatatctctgcctgtgtaggatcaaagcagagggaacctctgtgttttcaaataatgtttttcccctaaagcagcaccagtcctaattgagtaatagagtaacaagaagtagaaaggggaagctttagcagctgggccttcacctggtcttccaacaagccccaactcgacgagagccaaagcaagagacaccatttggaggggaagataagaagtcttcacaaggtcttttccggtgttctgctttttcctgggaggcggccttggcgtgtccctgagacctcctgtgatgctcacggctctggcgctgccatttttcttgggtgtcgtctggtggtgtctgcaaggccagctataatgtcagggctgtgctcgatagcacagaaaagacagcgtcctggaggagagcttgttggagcagatttacaagggagggtgtgggtgtcactcacagttcacgctacaggacaatccctttcactctgggagctgagtcccaggtgagagctaagttccaggcgagaccagggagtcgaggggactggatttctgcttctctcccaggagctgcgggctgggaaggggaaggaacagagctgaggtgtgacatcgcccccggtttcccctgttgcccaggttatagcttgggtggggctgacttcagaggcaacattagaaccttttaaaatacccttaatgatttacatgaattagaacaagaaggcagctgggtgtcgtggaaagcgagtgggatctgggttatgtcctcactgtgcctttttatgcacacaaagatttatctacccatgctatcaacttagtgtgtattatagtgaaatgccgtaaataatctcatgtcccctttatacagataagaaaaatttttcagggacattgagttaacttgataaagttctccagttatcaacctggtaattccagttctagaaaatggcaagaggtaaatgccaacagtgggtatttatataagaatgattatggatcagttaagcaagtcagtaaaaggaaatcgctagtgtgcataaggtgctattgaggcaatacctttatgcttttggtttataaagtaaaacattttaaatcttggtatttgtgctatgtctgcataataaaatatttcataattaaagtcatactttggaagattttttattatataagaaaatctctatattacaacattaagtgaaaacagtgggagaataaaatctaaaactacatatagagaccaaatcttataaacaatagattaaaaatactagtaaaaatagtataatgactatactagatttgctgtctctgtgtgtgaaattatgattaaatgatttctagtttatcctttctatattattccagatgtttcactattaacatcaattatatttataacaacagcagcaaaggtcaacgtgatttatatttttagaaaaccaggtattagtagttatggttatgtagcaaggctggctcaagaaatggatcagactctgagaggaaagacccacggttttgttgggtattcaccgtgtgctccccttgtaggtagaggtgatgggatggacctggcgttcactgcagctgcctgtctccacactgcacagcctgctttggaggacgcccagcctccccttgctggcctcctagcagtctcgtcagtttttcctgcaatgtgagtcactccctttgctgtagcctgggtgtacctggaaccagccaattgcatatccacagtcaggcggccactcagtctcctaccagagtttacaaagccagggtcctacaaacaccctcataagtgggcttattttggcccatcccatgaaagaagaggctgagtctgacaacagcaggagcagcagcaatgatcgcttattccgaggcctctatgtgcagggcacacctccactctcccgccgtgctgcgagccctttgagggcaggacccgtctgattcaacgctattgctccagcatagctggacagggcttcacactggacatgctcagtaaacttgagaacgtaaaacagatgatcgaattcctctgtactccagatgattttgctaaacagaattattacatatttaaaatacaggattatcactatttgaagatgaaattagacacttatataataaattaccccaacacttagtggcttaaaactatgcacatttgttacccacagggtctgggtagcagggatctgggagcagactggctggtactctggctcaggccttccaggagcacgcagctagtgctggctgaggcagctgtcacctgagggcttgtggaggcagcagggcaacgtccaggctctcttatgtggcctctggcaggaggcctcgggtgctagccacgtaggcccttcctcatgatgtggcatttggattctcccagaacaagtgactgagggagtggtgggagggaggttggtggagacagcagcgtagccccttcctgtgatctagtcttatgggttgtgctcgctcacttctgccatatacattaggagcaattcataaaatccagcccagacacaagactccacctcttgaagggagaggtattgatatggttctgctgtgtccccacccaaatctcaccttgaattgtagctcccataatcctgttggattatgttggaggagggaccctgtgggaggtaatttaatcgtggagatggttaccctcatgctttctcatgatagtgagttctcacgagatctgatggttttataaggggcttttccccttttgctcagcacttctccttcctgctgccgtgtgaagaaggacatatttccttccccttctgccatgattgtaagtttcctgaggcctccccagccatgctgaactgtgagtcaattaaacctcttttctttataaattacccagtattaggtatgtctttattagctgtgtgagaatggactaatacaggtatcaaagaatttgcggtcatcttttttaaaatcacaaaatttcaggagatttaattaataaagtgagactcaggtctaggcaggtaattagaggggcctccaagaaggaaacaaagactttgtctaacacactatggtctggagacagatctcctaggggccttgctcagctttttgcttacagcattgagctccagggattggctctgcttgccacagggtgatgtgccccatctctttatgttactgagggcagaagaagggtggatatctatagtttgcctgcatttcaggatccaagtcaagaaggagaagaaagaggaatggccctattgtgggagcctccatgatcgctactgcatttggcagtgatatatactcccttaacctttcctctgcaaagaaattgataatgatacttgcactagtaaatgtccacttctaaatgtctgtataaataaaacaagtatctaaactcattcttgccccataaaatgtctacactttaaaagtaaatcatgccaatctgctcatacaggcagaaactaaagagcctttaaatttgttttgcaaacaatcacatcaggatttgttctaatatactgatgcagtggacagatttatgatttttaggaagataggcacatattttgcagagagtaaaaatggaaattcagtgatagaaaatggaggtttgctccatgtaaggataggggctcatatgactcagtggaaaatagaggataatcgactctattatcctgcctttatgtggaattgcaataatgtccattcatattaaaaataaaattgaagactttcctaataatccagtcattcacaaataaatattgattgaatgccaaatatattccaggcaccagacactctcttaagcacttggatacagcagtgagcaacaaaaaaccttgccttccttggctttgaattccaatgcatagggaacaaaagcaaatgaatcagtaaaaattattacatgttatatggtgataaattataaaggaaaaaaatcagggaatgaatatagagggtcagggaaatggcttaaaattattaaaagcgtggccaagaggtcacgttgcaaagttcacatttgcccaaatagctaaatgaagcaagggagtgaaccaccacagccagctggaggaagagcattttgagaatacagaataagtgcaaaggccctggggtggtcggggagggtggtctgtgcaagagcatgacgaagtccatcgtggctgaggagtggtcagaagaacctgaccatgtgtgcctgttggttatttaaggattttggttttaaccaaagtgagctgggtggctgctggagggtgtgaaggaagagactcctaatctgagatggatctctgggatgaatggttgttggtgtttgagaagctattgcagtaatcgagtcaagaaatggtgctggcgtggccccgggtggcagtggtgggtgaaagcactgagagtgtgttctgcgaggagacttgccaagattgacccacagaccacatgtgggatattagggagcataacagtcaggtttctggcccagcccctgcaagtatagagtgccattgtttttagattgggaatgctgagaaaggaacaggtttagggttatgtttggtttgtaaagtttaagatgccattggatactgaaataaatgtatgaatctggagttcacagaaaaggtttcgattagattataatagagcaaaatcaacttccagagtagaagtgggagttttattttttatttatttattttattttttaccagaactgctatttttacaaactgaaagtcccttagaacatacactgaaaaaaaaatcccagttattctctgagtccttacatagaattgaagaccacctgcctgtttgtctttgcctgtttccttttcttctgttcttaactcctctccagctcctgaatagcaattttgtttctctctgcctcatgcaacagacttttctggatgattcgccccatcccccgtcatgccaagcctctgccccacttcatttctctttcagtgagtggagcctccgccgtctcccagacctattgttgcctggaccctctcaagcctaccccttcctctcctccctcccctcctttactccgtccctttccatggagccacactcggggcaagaccatctgctctggccttccgaggcttccgcactgctggcagatgctccccacgtcccctagaatggtttgtgatctttctctgtctggtcccaacatgcctttccagcctcctccctccccacgccagcagttaacccacgcatccatccaggagatttcccacacagactgcacataccgcacaggtgtgacctgctggtgatgatctgctttctctaaaatggactttcccttctgtctgcacttgctgatcaacaaaaagcctgctgggcctttaagacaggcctcaaaccacctctgctgtgaagcctgcccttcctcgtcaagaccccaaacgaggctcacctccccgtgaccgtgcagcgtgctgctggtcctgccaacggtgcccctgacggagctgtggttggtcctgtgtttacctcttcggcctttccacccctccagaggtccgcctcttgtctccaggtctttgtatctaactgaccagttggacactcaccaacctgaatgccatgtggtgttctggaaagcttcctctgtaatttccagttcagatcagttgttcatcctgtgcactccagtctcatcctgtgcttaattctaccacaacaaacaacgcagtattaaaattgtctgtgcagctttctctgcagtctgaaagacctcgaagagaacagacctgccttatttactgtgcgagtatccagctagagcctggagctcagtaaatatctgtgatttcactctttctctttctccttccatcccttcccctgtcctcctctccctttcttctttctttccttctttctttcagcacacatcagtacaattccacacaatggaaagagaagagtgaacaaggcaggacatttagaagggaaagtggaggagcaaagtgaggaaatcttatcagaaaaggggtgatcagcaatgtttaatgttgtcacaggcaagaaatatgcaggcaaaaaaatcctttacattctgtaactaggatgttgcatggagatttatataaagagtgttgggctgggcacagtggctcatgcctgtaatcccagccctctgggaggctgaggcgggcggatcacctgaggtcaggagttgtagacaagcctggtcaacatggtgaaaccccatctctaccaaaaatacaaaaattagctgggcactgtggcgggcgcatgtaatcccagcttctcgggaggctgaggtgagagaatcacttgaacctgggaggcagaggtttcagtgagccgagatggcgccattgcactccagcctgggcaacaagagcaaaactccatactccatctcaaaaaaaaaaaaaaaaaaaaaaaagaatgttaacacttcttgctcctaccgtcttactcatttcttccttcgtcactcattcattcagtaaacattggatttctatttcctgcctcctctaagattttctaggcacttggacctcaaagatgaagctattctcacacgcacagattgtcaggactttgaggctttatgggtgatgggcctttacacattgtactgtctccataaagcccctccttagcttccatttttttttcttttgagacagagttccactcttgttgcccaggctggagtgcaatgaatggcacagtctcggctcactgcaacctttgcctcctgggttcaagcgattctcccgcctcagcctcctgagtagctgggattacaggcacacaccaatacgcccagctaatttttgtatttttgtagacatggggtttcaccatgttggccaggctggtctcagactcctgacctcaggtaatccgcccgcctcagcctcccaaagtgctgggattacaggcatgagccactgtgcccagccaagcccctttttagtttctgtggggacccctcattcagccacagacttgccccttcaatggccacttcattcttccatgtgcgtttttccttgttctcaagttgtctcctcagcttgagtgtgaaaaacatttcatgctttttagtatcatccttaggataagtctcatatctgtgcactttcatattgatcaaaaaaatcacaagaggataactgaatggacaactataaaacctcctgtttctctatttcatgtcagacaaccctagctcccttagctttgcttccagctcctttttcctgatgctttaatcattgctgttcctctcttaatgtgcatcatgcacactatagttctctaaaatcaggccactttaagccatccacaggattttatggaatactaatcagtgtcatgttccactcaacatgtgatcggattttgagagcagtgaacagggtgtcctctgagggcctggggtaatacccccattctgaatcacaaaggccagccccatggggtcagagggttggcctggttagccttgtggagcctgtgttctccaaacagacatttaattactgtccccaatgagtaccctgatcacaatacttattgctccaatggggtctgtgggtggggattgcaaaggggaaggttgccctgcttagctcaaggggagcatctcctgagaaagctgattccgacagaagtgcagtcaactcagcaagcctcttccttctgtcctgttcctaaaaccatctgctcattgcaggaagcgactccattccgtcagccatactgatggcattaggttctcctaaaacatctgggttttccttgtgggagaaaatcctgcagtgaatttagatgttggtggacctctaagcaagggcctcattgagtataggaggggaaattataaatgtcaaattataagtgtgcaaattatacaagtgcacccctgcttggccttgcagggcaccactggccagctcccccctctccaatttttcttctgttgccgtgatggtgaatgttagttgtcaacttgattggattgaaggatgcctagatagctggtaatgtgtgatttctgggtgtgtcggtgagggtgctgccagaggagactgacgtttgagtcagtggactgggagaggaagacccatcctcagtgtgggtgggcaccatcccatcggctgccagtgcaggcagaacaaagcaggcagaagaaggtaagataagcttactcgctggttcttctggcttcttgctttatcctgtgctggatgcttctttcagcttctcctgcccttggacatcagactcccggttcctccgcctttggactctggcacttatgctagtggtttgccgggggctctccagcctctggccacagtctgaaggctgcattgtcggcttccctggttttgaggcttttggacttggactgagccactaccggcttctctcttccccagcttgcagatggcctatggtgggacttcacgtcgtgagcatgtgagacaattctccctaataagctccgtttcatatacacatacatcccacagatctgtccctctggagattcctgaccaatacggttgcccacccttctttgtctcttctttgccacgttcacttctacgtggcctcacggaacccacgtggccttgcctttctggaatcgcagtctcctccatgtggagatgcgtcacctgtagctgatggataatcacttggaaatgcagctgccccggacgggaaggggttgtgcatttctcatattgtttttggctagaccttgagaaattttgcttcctggacaacttagtcatattttatgaagatcctttgtcagtggctagaaaattggacatgtatgatatatggctggggaggactaatgggctcttccttcaacactctgtcaaagtggggccagtgcccatggtggaacgtgctttagtaagatgagagaaggtgttttcatgattaacaaggcatggcattcgtatttcaaagatcacatgacatatcaaaacagtctgctaccgtgtatttatttggtggcatggacatgggacatgtggtattttctcagggacccttcggccctggacctgtgctgtgcaggcatctgcctgtacacactgcagctgttaacctgtgcataacaaacagccaatgtaagatcagatttgaggctgggagtggtggcacacctctgtgtgtgtgcttacataacatacactcaatgtaagatcagatttgaggctgggagtggtggcacacctctatgtgtgtgcttacgtaacaaacactcagtgtaagatcaggtttgaggctgggagtcgtggcatacctctgtgtgtgtgcctacataacaaacactcagtgtaagattaggtttgaggctgggagtggtggcacacctctgtgtgtgtgcttacataacaaacactcagtgtaagatcaggtttgaggctgggagtggtggcacacgcctgcggtcccagctactccagaggctgaggtgggaggacgcttaagctcaggaggtcaaggctgcactgagccatgatttcaccactgcactccagcctgggtgatagagtgagactctgtctaaaaaacaaaaccaaaaaaacataagatcgaatttgactcgaccgtttgtccctctgacacgtaatctaagatgtcagaagtatttgtgtcaaagaaggcaagtgggagagaccgggcctgaggtgatgctgtgttccttctttgatgacatcattaacgaggagagggatggccaaaagaatccaaaatgaaaagtgtgctgataacagaaccaatcacaggcacaactagcctgggattccaggcctgccgaggctgctcactgcggagcctgtgtctgattctgtgtgaccagagccttggctgcaaataacgaccagcctttcctcatcacccaccagcaggcacccaccacagccctgtttgaggtcctttgaactcacagttttagaaaaggtcagtagtcaggtgatatggtttagctgtgtgcccacccaaatctcatctgaattgtagctcccataattcccaagtgtcctgggagggacacagtgggaggtaatcgattcatgagggtgggtctttcctgtgctgttctcatgagaatgaatagggcttacaagagctgatggtttataaaggggagttcccctgcacttgctgtctttgtctgctgccgtggaagacgtgcctttacttctcctttgccttctgccgtgattgtgaggcctccccagccatgtggaactgtgagtccattaaacctctttcctttataaattacccagtcttgggtatgtctttattagcagcatgagaacagactgatgcatcaggataagtccacattgcaggctcttcagggcatggccccgactcgctttcccatctcacttttggcctgtccctcatgtgtaccctgggcccagctgtgacctatggaacggtataactcccctgaatacactgtgctcccacagattatgtgcctgcccactccatctccacagcccccatggagaggagagaaaggggtggcagactctgcctatgcgcccttgtttcttactcagagataaaagttcattcagaaaacatcttgagttcccccaggctccgttacttccttctttgctcccatagcattacctggtgaaaagtgcttctgttgcaaaacttatgttcatgtgtctgcctcacttctccatgaggggctcagtttcttaagaggaggaacagaaaggctaggtctggtctctgcatctccaaccgctaggccaggcgttatatccttggtgcgtgtttatagaatgtgatggtagacatggagtgtggtggggtgagcagagcagatgtgattgacattctggtgaaaaggctgagcaaacacaggacccactgctctgtccctgcactgggctgcgtgctggagattcagtggccactcatgctgctgctgtgttcttgtggaggtaagaggcagtgggtagaggagcaacaggtgatatgtgaatgctcctgactttgtaggaaatgggaaaggggctgatgggtgggggtgcacgtgggtgaaggaggtctgggaaggtgtctctcctgagaaggcagcagctggtctgggaatgaagggtgcgatggagctcactgacaacccaggcacaggtgagagcaggtgcacagtccctggagagaaaagaggctgaaaggctggaggaaaagttgagacccatgtggggagggacggatgaaggttcagatcaggggcctccggaagtgagggaaggagcaacgcactgacgctgagtgctttcaagcaggggagtgcagagaatggatttcaccttgaaaagtgaatgtggaccataacaagtgttggcgaggatatggagagaagggaaccctcacacagtgttagagggaatgtgagttttacagccatatggaaaatagtgtggaggttccttaaaaaaaaaatccaaaatagaattactggatgatccagcaatcccacttctgggtttagaaccaaaggaactgaaatcagcttgtcaaagagacatctgcactcccatgctcactgcagcactgttctggatggccaggatatggaaacattccctgtgctcatccacagatgaatggataagaaacgtgtggtgtatgtacacaatggaatactatgcagccttaaaaaagcaggagagtctgtcaattgtgacaacatgaatgaacctggaggacattgtgttaaatgaaataagccaggcacagaaagacaaataccacattatgtcacttgtgtagaatcttaaaaagtcaaaattacagaggcagagactagctcagggatggttgggggtgggttggggagatgttggtacaaggatataaaatttcattggacaggaggcataagtttttgagatcaattgcacaacatggtgactatatttaataatgtaaagtatgtttcagaaattgctgagagtagattttaaatatttgtaccacacacccacaaacataagtctgtgaggtgatatatatgttaactagcttgatataagcattccatatgtgtatatgtatatcaaaacatcataatggaccccatgaatatatgtaattattatttgtcagttttaaacattttttttaaatgaacatggaggttggggaaccttaccagggttcttttggtctccgccttgcctggggcccagaagtgctggtgaggggttgctccctactctggagctctggatgctgatcagagaccctccatgcctggtgacatctcagactcagtgaacagcctcaggggcccttcacaaaactgggctgtcagggccacctggagctcagagtggtaatttggttccatttgaacttcaattttcgttgctttgaaatctcattcagttgaatttaataacaaataaataattcatggggactggacaatgaaaggaaaatttaaaaatgtgttcacccaaatatataaaggggcaccttgtccctcagccctgttctctaccttcttttctcagctggcttctgggcagattcatggcgccaaaggatgatgcgttaactctctcagggtgctgagggttctctcatcatgagacttctgtgggttagggactgggcaagaggtgagcaagtatcccacctctggcaggccagcctctcagccaccaatttgctaagtggcccaccggtcatctctgagccttgtttccttgcttgtaaaatgcagaaatctttagtaaaccaattgatgtaggcaaatgtcatgaatggatacacagtcatctcagggaatttacatggtgttaaagtatcactccagggatcatctgctggttgcaaggggagaaatgtgactttatcctggagaacaccgatgctctccaccttatcaattcctgcatccctaacactgggacaagcagatatccttccatgccccatgcggtgcctagcatcacctgtgaggtaatgccacaaacttgtgagctgaacttaatcaagctcttaggtctaactttcagtgcgtaacaaacacaggctgcagagcatccagctaatgcacaccaggaggaaacagccagacaaatccagaaggtggaaacgtggaggcaacaactcacccattccttccagcaagccagcaatgtgtggtgggctggggagccactggggcggacaggttctaagttgaaatatacgttaccaccaaccaagggcaattcctgggcctcggctaaatccttacctatacaaaccagctataccagtcactttagagtaattggggaagttattacatgagattagaaaattgtattcattttttaagtgtgaaaatgttctttttcctttttaaaaaagcttctgttttaggttcagtggcacatatgcaggtttgttacatagagaagcttatgtcatgggggtttgttgaacagactcttcttaattatacaggaaaacgtctagagcttgtggtctctcttctttagcgttgcttactgagattttttaaaaagatgcatcctgaatgatttcgaggcataatgttttggtacctgtatgcaattgaaataatttttaaaatagatatggagtaaatatgaaaactaacaattttcaaaattttaatgaggagcatatgaaaattatactctagtatgctgttacttttcttttctttttttcttttttcttttttcttttttgagacagtcttgctctgttgcccaggctggactgctgtggcacaatctcagttcattgcaacctctgcctcccaggttcaagtgattttcctgtctcagcctcctgagtagctgggattatggggcacccaccaccatgcccagctaatttttgtatttttagtagagatagggtttcaccatgttggccaggctggtctggaactcctgacctcaagtgatccacccgcctcagcctcccaaaatgctgggattacaggcgtgagccaccgcgcctggccgctgttaattttctaatctttaaaaataataatagtttttttaaaaagctgctcacaaatattttattgatgatgtgtgcatttttttttcctctggtaggacataattctccctgagaaggggaaagacagtaagaattttgtgagttgcataatagtccattgattaccctttgtcccccagtggagggcactaaacccctgaagaagcaggcccctgtgtgggcgtgttatgattgtagaacaaggagaggggaccctccagtactcagtgtctttagtgggtggggcgggggcttcaaggcagtagcctcagatacctgcggggcccatgcagggaaccctaattggggtgcagggtgggggagcaacagaatgcaaaatagctcttagtaccttacctaaatattggttgctagattttttcattgactggaagctttcatttggctctggatagaagtgtgggcagtcacacaagtcaaggtaagaggggtggaaactggtttttgctggtgcttcctaacatttgtcaactgtggctttcaggctaccaatgggtggggagttttgtgcgagaaaatggaccacatttgcatcctggtgttctccaaatgatgttaaatgcagaaacattcaatgcaatgagtttgttcaattccatccaactaaaaattgtgtttgtgctattagtgcctaccctctgatcagtcttgtactaggtaggaaacatggtgcttaccctttactaaggagttgtgttacatgaaacagaaaacactatgactgaatcaaaaagaagcatcactctgcttgggtagtcagggaagaatcttgatttcccctggaatctggtacttacctcgcggtgaatatacaataacagccagagttttaaaatagacaagaaggacagaaatcagagagaaaaacacagacacatcagaccccttatcataaggtacaaacaatagagcagaagggagaccacaaacttccattctttatgggatgagcgagaaaggggatggaggctttggcaatgttgaatgggttttccacaggaacagccagccccaactgatgtgtagtgatttcctaggaagtttgcaaacctcatcccaccaagaggaaatgggtcgggagttctccatcatctggaggtcacagagcagacagaccatggcccaggacaagatctagaagttgttattttattcaaagtcagaaaaccttccagggtctggggatcagtgtctggatagaagagaaaatacaagagaaagcaagaggttaatgtgggctgaaggcttagaatgagcagttttaggataaaggatagttaggaaaggatgggggatggagaggagggtgcatgtaaggcaggacaaaccaaagagaaagacctgaatgtatctgctgtgtctgtgggacatagggaggttctgttcattctgaatgggggcttcgagctcaagcctaaaaatccatcctttcaaataggtacagaaagaagggctttgacaagtaccatgggctgtgcttgattgaaaggacagacacattcagttgttgttatttgtgattattgtcagctccatcattgatggcactgtgcattttttgaagtaggtctctcccatcaaactgccaggattccagtgatcagagagcaggtcttcagtagcacaggctggattgggtggtgcccactcccggcttgaccacttagctctgtggtgccttggtatcctcatctgtaacgtggggataataatggtgtctgtctcataagaatgttttgagaaacaaatgagaaaacccaagtcaagctcttctagaagtgcatggcagatagtaaacagtcaatcaacattatcagtcctatcaccggtgtgggtactgttgagatacctgtgagagtaaatcatgatttatgccaatggttaatggaaaatatttattttagttattttcttatctgggtagtgccagatgggataataaaaatgaaaacaggcagggtttcgtgtgtgtgtgtgtgtgtgtgtgtgtgtgtgtgtgtgttgctttgtttgcaagcatgatttagttgaaattagatgtctcttctgatctataatctctttgtcttcagactgaaacctgaaatcccatctgaatatggctgaagcaaatctgcacacagtgtcttgatgggaggatatgactaactcttagattggaattgtgttggtgcgtaggcaggttctattattaggggtaatgttaccacattattaaaatatttttaggcataagacaggattctttccttcacagataaatggtgaaacacacatattcctaatttttaaattttgatcaaaattttattaaggccaaaatgggcagagactgggtaacagaagccatattttccaatttgccctcctttactctcccagattctccttgcatgttggctggagtggatcacgaagggtaggaagctgagaaaggtggaataattggaatgttctgcaactctgaagccaaacaaacttaggttttggatgacgtggacagtggatatcatatcacctgttatggtgaaaccatcaccaatacttactttacaattcccatcacacaccccagtgactttctgtgaaagagagatcagatatctactgtatttagatcaactattacattatcaacagtggaggaataaggaaatctaggatgctgtttagtagcaaggaatgcatcaacaatagataaaaggtggccaggcatggtggctcacacctttaatcccagtattttgggaggctgaggcgggtggatcatttgaggccagaagttcgagaccagcctggccaacatggtgaaaccctgtctctactaaaaatacaaatattagccaggcgtggtggcacatgcctgtaaccccagctcctcaggaggctgagggaggagacttgcttgaatccaggaggcagaggttgcagtgaactgagattatgctgctgcactcctgcttgggcaacagagtgagactccatctcaaaaaaagaaaaaaaaaaggaatctctcagtaggtactaaataaaacagggaaaaaaacataactaaacataactacaaactttcttttctttcttttttttgtgataagaacacttaacatgagatctaccctctccataaatgtttaagtcttgttaactgaaagcacaataggatacagcaaatatctagaacttatttcattttgcacaactgaaactttgtacccatggaacgcctcccatttccccttctcccaagcccctggcaagcacctctctactctctgtacaagtctgcctgctttaggaagtggaaccatgtagggtttatccttctgtggttggttcatttcacttaccataacatcctgtaggttcagtcatgtttttgcatatggcaggattttctgctgtattaaggctaaataatacttgatggtatatatgtgccacattttctttatccattcgtctgtcaatgagcatttagatggtttccacatttgggctattatgaataatgctgcaatgaacatggaagtgcagatagttctttgaggtcctgattttaattattttggatacgtacctggaaatgagattgttggattatatggtggttctatttttagtgttttcaggaagcctcatactgtattccaaagtggctataccattttgcattccccccaacaatgtacaaggattctgatttctacacatccttgtcaacatttgttttcctacatatatatatatatatatacacacacacacacacacatacacacaacacacacacctacatacatatagatatataatagcaaccctcataggtgtgaggtgatacctctttgtggttttgatttcatttccctgatggttaatgatgttgaacatctttttatgtgcctgttggccatttgcatgttttagttgaagaaatgccttttcaagatttttgcttttgtttcttgtgcttttggtgtcatatccaagaagtcattgcctgggccaatgtcatgaagcatttcccccatgccttcttttgggagttttacaatgtcaggtattatgtttaagtctttaatacattttgagtcgttttttatgtacagcataagataagagttcagttctcttgtatggatatccagttttcccagcaccatttttggaagagactgttattttcccatcatgtattattggcactaactataatggtgaaaagttaaacgcttttcctttaagatcaggaacaagacaaggacgcccacagtcactgcttctattcagcatagtagtggaagtccttgccagggcaattaggcaagagaaagaaactaaaggcatctaaatgagaaaaagataaaattatttctatttgcggatgacatgatcttatgtgtagacaacccaaactttcttatcttcacagaatattttgcaagagttgagctcctagaaaatgagcttagatcatttctcccctctggccagtaacaagatgctcctacactgagcttcatttagcacagccctggacacaccaccaggcactcagcaaacatcagacaatttccagttcaatggaaaattctcagttatccatggcagaatcatggccctgtcatgcactggctgagtttgcttgaggaagctgcttaagctttctgactcttggttttgttatctgcaaaaggggaatagcagtgtctataccacagggataatatgaaggctaaatgagatcctgtaaagcaatctttccaagtcctgagcttgacacaataataaaaactaacctttatttaattattgagggtggaggaaggaggataaagaacagaaccaaagaacagaagttatttcccagtgaacttaaacaattcatgagttttctcatcttaagcagggaggccttaactgcattgtctcatgcctttaaccagtgagagtcagagagagctaaggcacatccaactccgttgctcaactcccaggcacccagcaacaggtatagagcattgggagctgcactctccatactgatgttataattaatcttccacctcagtcaaccgatcatagagttccacttttggaagtgttccaacctgcacccaggaggcttctgcagtcttttttgctgccagaatgtcctccctgatttacacctgacttcggcaacatctgagcattcatatctgtgctacatgctggctgtagccatgggtctcattctaaaacatccttgccttcaaatacaggcatgaggcaggagtggaggaaggagaggtaagaaactattcatcggccgcctcatgggcatgctgacggcaagagttatgaggtgtaaacctgggttcacatcttgttttcttctccaggtgagggtacttcatagagctcagaagaaactcaaggaccagctctctcgggctgcccctgtaatatggcccactgagggcaggttcctggctgcccttggaacagtgctgcagtcatcaggtggtgtgaaagacaaatgcctttgtgccctcaaaggcaaccagtatatatgggaggtgctgtccccccttctgccactcatcagctcatggtaaacagaggccacttaggcaccactcaaggcattgaccagtctgagtcctaattatagggtcctacttatagccattatgaacctcaaagccaaacaagatgaattttgtcaaaggactcctcctggctttagttgaacagaatcatcagactaggaagccattagtgaccttcgtgagtttccagatcttcattctcatggctcttatcagagatttgctctgaggtgatagtgttatagggccctgatgcaaaaagcccagtgcagattggcttacctgctgctgcatcttgattgtccatgggtggggtctactcctgaggtcttgggattgaaaaagttcacacggactgtaaatcctgccattgctactgatgacacttgtacttgttgcggtgtgtccattgtagtgggaagagctctgctcttagagtgttatacagcctatagggtttggattcttcacatttggttggttgactttgagtctcagcactttcaattgtaaggtggggacagtacaaacttacagaagttattgtgaatacacaaccatccaagtaattacacctgcagagctgactagtttactttcttgcttgctgtctggtaaaactcttgccaatcatagacaaacgatcaatgcataaggtaacctcatttgagagttcaagttctgaacagaagaaaaggatctcattcctgttatgaacagcttagttataaagtcaaatgtaaaatcaaatatgtgtttctgtggcaaatggttaaattcttaccttttacaaaacattcagtagtcacaaggtctttacacacccactgcttatccatcatatttatatatggtgtgcctgttaggtaagacatacacactttggttagttacttgaatagatcataaaattaagtctaggactatgttttctgctttatttaaattttctcatccaaggaaaaatttcataaagagtggttaaatgaatgaatgaatggacatttactgtcttgaataaaacctttttatataacttagcttgttttgcaaaagaataaaacactgggttcaaactctttatttttcattgatctttagaaatcagggtccctcttttgaatacaccccttgctcaaggaaaggaaccatttatgttctggccttgattactgcacaatggcttttactacatttgatttgcagcagttcatttgtgattaaattttctaattctcccagaaagtcattgaacaagcaaacagtttactttccccaataaaacaaaacctaaagtatttggtctttaataaatgttcaaaaattattttctcagtgtgtgttcgagatataaatatcccttcatctcaaccgtcttttaaatatttgaccaatctacctttacagagtagttgtttctccttatgtcatttctgatctatctttcttgaatttttctttgcttagtttttaatcaagccaaatgtttgtttaatcagatacctcaattagtcaagacctgtctcttttatcagaaggtgaatttagagaacaattctaaaacatagggtaatacaatttttttaaaagaaaaataaccaaattctaagctcagcttggtcccagggcaaattcactcctcattcttaattcttcttctccatttctggtcacgggaggggcacccccaaaatgctgaccctaggactccccaagatcctccagcatccaaaaggcctctcttctccagtctttactttctatgggaacaggttgaaacccctgggaatgaatacattctcaactaaaaatacaaattaaaagaatttcttgcttagactatcagaaacttgatctagtgcacatatttcccaagcatttcatttactagatctgattaagacactctgttattgtatcatttaaatttttaaattttattatttaaattttaaatacaagttttaaaggatggttacaaattagtaactcaaaataattgagtggagagatcaaggtacaagacactctgcctttaccttcaaagtctgagcaaatatgattttatatcgttttaatcagagattcttttaaagaccaagttactgcagtcctgtcttgttcttctcctattttatactgatgtgctcagtaccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcaaagtgtgtgtcaaatgtcgtgagcttagaagagattcatcgtagagactgctgcttaatgagtgtaaattaactgatcatttgctaaatctgatgtgcccagtggtgtgggtgggagaatgctggataggatgtaggagatgcaggtgagcagacgggtagcagagacacataccgtgtttctgagcgaggactgtagcatggccagaaggctgttctgatgtagagagggattttccgctcacggtaggacccagtaccatgagactgaggactgaaacacaaagttaacacagatctcccgaacagtctgctttagggctggagcctgctgggatcagtcctcttgagaagaactacaatctggttgagattgaacttgccaaagacaatgagactaaacaagagatgcctgctggtaaacatcaggggtgttgtgtggaagctgagggaggaagaaaacacaaaagctgtgcatgatgataaggctagtgggcctagtgttaccagtaccacagatctacagctcctcctagaggcagggcacattcagaataagcaacagggagctgcatgtcatgtagtcaagcaactgtatatttcttcttcattgatttctgggacatacatatgaaatatcttcagcttcatatctgagatggcaggaacatgacaacatattagcttttaggtagacacccgtaggtcttaggatgtggtggaaaattgggtgtcattttttccagataatcactggcatttttataaaacatgaagcccttcctaaagtctgtgcttcccagatagtagtgaggagaaataggcttgtggagaccataagggtttattttggagtgggtcttgtgaatttgacagtttaatagtcacgtggacgcacactgttgtttgcaggaggggccatgaacccctgccctgaatgaaagggaaatacttatgtccgtggtaaccagggccagtggcagccaggaagccaagacctggcctccgctgccactgctcatacaaaccaaacgtgtacatcacgtatgggatataggagaagcacatctgaagggctatggcagaagtggaaagaaggcaaaactcttccacacaggcaacccgtgctttccagacaaatctcacaacatcaaactagaagtattcatgccaccccctacccctgccaactagaactggctgtctgtgtcaggtcgtcatcttatcttagaacacatccattgatacatacactgtttcttcttccctattacctctgattctgcttctctaaaataaaagctgaccgactggttggaataataatacatataccacctggcattttacagttttacatcatctcaggtgatacaaccaggctatgatgcagtcatgtcaccatactctttaccagatgagatgcaaactcagaaatattaggaaatgtagctgtgatggattgggctataatcaacttgtgatgtgggagtttctcagaatctctttccctatatacatatggttccgagctagagctggccacagtgaagccatgagacttgggaggtgaatgaaggaggggccattatgctctggaggttttcatcgtgtaactgaacacaggtccggatgctcaccgcctgcagaatccagttaacaagaatgagttctggtagaaagaaagtgactttattcactcaaactagtaaagaacaagtggccgggttcccatccaaagcaaccacttcaatttggcagagaggaagacaggggtttaaaaaaggaaatcttgacgtgaaaagcttgcaagaattgtgctgagtacaacgtctgtgtaccttgttctggtggctatcttgggtcccagtttacctggatctcgggctggtgtcatctcaacaatggtgaggctgttgactcgccaccttgaagtcatctctggaactttgcaggtgggtctccagacttggttcatgtgtctcaagattacccccaggagcttctaaaaagggacataattagatgctagcatacaggtagatgaatgtgaagggagtatagatggtgagaaagggagggatgtggagttcattttaagacaaagagggaaaggcttctgcaatttgcttcaaggttatatcttgaaacgcacgagaaataagtaaaaagtttaaaatgcattttgcagttaaactgcccagttacaattggtcagaagtggtgagagacacagtggagctgacacagggtgcaagtttgtcttcactcttccttacccctgtctttatttcccgatttccagccctgctgacttgcagtgagtccagggccaccatgcgatgctgtaccccactcgacagacctttacttccatagcacctcacatcattcctgtaaaaggttgttactctataatattccaaatattgagagtttcactctcaagtttgaactctgactgacacattacctgtggtctccaggtgggaggtgatgtgttttttacactttataatttttttttatttttatcactcactatacttgactgtgttatgatttctatattcgtcattcttcctgcatcattttctctcttctttttttttttttctgagacagagtctcgctctgtagcccaggctggagtgcagtggtgtgatctcagctcactgcaagctccccctcatgggttcacgccattctcctgcctcagcctcctgagtagctgggaatacaggtgtccgccaccatgcccagctaattttttttatttttagtagagacggggtttcaccatgttagccaggatggtcttgatctcttgacctcgtgatccgcccgcctcagcctcccaaagtgctgggataacaggcttgagccaccgcgcccagccatctatgttcatttcaaaggggtcttccttaatgatagtgcccttgaaccaaaaattaaagagttgattaaagtagtagaaaatggtcatctatacaagtttcatgatttataagaactatggaaattgctccttagaaaatagctttctaaacatgaaaatacagttgattagaaacagtacacatgaggaactctggtttcatgcaaagttgaaggaaattcttgtgaaattaaaaatgcacccagaacagttgatgaagtctagtccaatgaaagggttttcaactgtttgatttccatcttgtcaaagaatcaacttttggttttggtgaatgaagtggtttggctgtttccccacccagatctcactttgaattgtaataatccccacaggtcaagggcgggaccaggtggagacaattgaatcctggggctggtttcccccatgctgttcttgtggcaatgagttctcaggagatctgatggttttctaaggggctttcccctttgctcgactctcatgccctctcttgctgctctgtgaaggggcgccttcctccataactgtaagtttcctgagtccctcccagccatgtggaactgtgagtctgttaaacccgttttctttataaattaaccagtctcaggtatttcttcatagcagcatgagaacggactaatccggtaatattctccactgtttttctattctctacgttatttacttctgctctattatttattgtttccttccctctgcttgctttgggtttagcttgctcttcttttgctagtttcgtaaggcagagtgtaggttgtggattcgagatctttcttccttcttaatataaatgtttacggctataattttccttccaattactgtttttattgcattccctaagttctggtatgttgtgtggtatttttgtttttattcagctcaaagtatttttgtgtttcccttgtggtttcctccttaatactttggtaatttatcagggtgtttaatttccaaatattcttgtgtattttccagttttccatctgttactgatttctaaattcattctgttgtgatcagaaaaagacactttgtgtgagttgatttcaaccttttaaaaattatgaagacttgttttgtgacctcacatacagtccattttagagaatgtttcaggtgcactggggggacatgtgtattctgctgggcttggcagagtctaataatccctaatatacctcgcttctaatgtaggtgttcccaccagagcatgccagtgtcatgtccacaataacaaacaaaaattcttttttttctttttctaaagccatattgtagattcccagttcaactataatatatattattttagctatctatttaaagtgtcacatcatcctagggacctttcaacggactgactacatttctcacaattatagtaattactgaaaataaacacatgagactattctcttcaactaaaatatcatcttattttacatttagtacaattgagaaatttgcatgtaaagctaaggaaggacacagctttagaaacaatggactcatttctctccagacctatgtgaaagttggtttgacagtaattaccttatgggagcccaaagttatgaaataaggatgaggaatgattgttcccatcacagacggatcaccacatcatcccctgtgcatttgcatgttgtgtactgatcagaggtggcgtggtgtggaggggcggcagtggtgacgtggaaatgtaaagaatttcgtgtactgaggatccagttaaaaatcacactggaaagagaaccacatatagtcaaggaaagaagaagtggcctacaaacctgtgatatgatcttgaaatgacttattttaacaagcatacctcccatctattatataaaataaaccgaagttactagaaagagatgggggttaaattccctatcacttactagctgagtgactttgagcctgtttcctagtctctgtgagcttgtgtttcttcatgtgggtaatagaagtcataataatactcactttagcaatttgctgtaataattggcaacaatatcttgaagcacagattataatgtccagtatgtaatagccctcttgtatgtcgctgtattctttctactgtccatagttctttaggttattagactgacttatgaactttgagcgctggtcatcagacctacttcacatggagcctcgagacccctccctcgaattatcagacccttccccctctggccatcatcctcctccctctgatcatcactgtgcgccctttgaccatcaccctcttccctctggcatcagactctcctccctctgcccatcctcctcctccctctgaccatcaggcccgccttacttcctcataccagcagccgtggagtggatcttcaacaagcagccaacagcagccagggacagatcctcgggcactgtttttctgtccgaaaaatcagaatcgtatcaaagggtcggacacctggactggcaagacacattggggttatttataacaggggaaaatgaggtctccagggaaacaaaccataataaagaatatgaactcccgcagaccgaattgccttcaacgatcctcaaagacttttgtgtttgaccaatatcaattaattacatcagtaaataactgcctgagccttgtacttctgtcctcccaagatccagaatgacttctgctttcaaaatgaatttcagggctttctttgaagcagtcttgtaaagttgttatatttagtttaaattcaattaaagctcaatctgaaagctctttctgaagcatttgttccacatttacatgaaggtatttgctcttaaaattgttaggggtatagctcatttctagtaataataagtggtatttcataaaccaggatacatgatcatttacttcctgatagcttgcttctcccagatctaattctattcttccttgagggctgttggtgccagtgccagggctgcaaacatcagggttagactggagagtgacccgtgtgctccttcacccctgggtggggcctctgtgcttatcagtaggctagcaccaggtgcaggagacagatgtgccgcctgctcacagggcttacctgggacaaatgtgccgctcgctcacggggcttacctggggacagttgtgctgcccgctcgtggggcttacctggggacactcactatgattacctgggacaaatgtgccgctcgctcacggggcttacctggggacagttgtgctgcccgctcgtggggcttacctggggacactcactatgattacctgggacagatgtgccacccgctcactatgattacatgggacagacatgctgcccatgccggggcttacctgggacagacgtgccacccactcactatgattacctgggacagacatgctgcccactcactatgattccatggggacagacatgccgcccacgcacggggcttacctgggatagatgtgccacccactcactatgattacctggggacagatgtgctgtctgctcacagggcttacctgggaatgaagttccactcctccacttgcttagttcttgtttatttgtctctcccaccatttcaagtctttgctatcatcatgaagaaatatgcagggtgctggctgtgcagtgatgagctgggagaaaatgatctgtgacagagctggtagttaaggaagaatcccttggctgaagcagagtgtaagggatgagaagccaaatgggtggagagcgggagcaggggaggagggtgagagcatgagagggacactgcatctccagaggctggagaggggcaggggtgcagcttgtcatgggacatgtaagagggccagggactgatgcagagagggacaggaagcagcctgcaccggcactgtgggagcaggcagatgggaacgtggacagggagttagtgttttctcctaaatgccatggaagacattgatgtattttcaacagtgcagatagaaagcagtaaatggtttcaaaaatatcccaaacaatacaatatatagaatttcctgatggatttgacttgcaaacagagtggaagaaagaagtatgatggcatctatgctttgtgctttttgagcaattggttgaatatggacaccattttctgtcactgagaagactcagggaagggcgggaggatgggggtaagtgtgcagggccggtgaaactgggagatccgtgagatgcccaagtggcaacgtcagctctgaggaaatgacactcagagacatggcctggactcgaaataaaatgtgggagtagttagcacacagattatgttccgaacctggaaatgaatgaccacacctaggaagaaaaagcaggaaaagagaggagagggcccttagagatcccaacagagggggctgaggtgtgtgtgtgtggtgagttggaggacagccagaagaaaagatgacgttccaacagctgagatgcagtcagggcgcagcccattggtatgcagcgtggaggtctttggagacatcactaggaaccgtttactaaaatgtcactaggagcagtgcctgtagaaaccagatcagggcacacgaaagggtaaatgggagacgagggagacatgacactctgctgtgtggactcagaaacctttctgcaaagagaagccaggaacacagcaggatgcaaactaagacgtgaaaactcattcttcgaagtcctttcagagtcctacctgcttctgtttatataccgcctacatttctgaaaattctagtgtaaaacaaacatgtatatattaaattacgttccttttacttttgttaaataaaaagtagtcgcattagagaagagcaaagctaagaaacataatgaaatgatgtgtaaggatcctaacatgaccactaaagagcaatgcacctgagtgtgaacgcatcaaacgcttccaggcctggcagtcaatccatgtgccatggcctcttacaaggaagtcatcgttctaacaccccatcggtagggcacaggctttggttattttatcagtgcacaaaaatgaattcacactgttactggctttcttctgctggtgcacattaggtgtgatggctccttgggcttacggatgacccctgtggctagaggcgagggtgaagataatgggttcacattgcacagattaaagcagagactctattgtgttcagaagaacctagagttaatgggccacaaacagatcatcttctggcctccctagcagagccctcggttgcctcctgacacagtccatttccactttgacacaagtgtttgccagctttgtggtacctgattattagggtcctcttagttctgtgattgctccaggaattcggtaaaaattgtcatctggaagaaccaaattgcagttcttaactgggtagaattcaggctcttcaattcttgattccattcattacgtgctcactgtaagaagtggtacctccttgggatattgaatcagaaaggtattagagaaagggctattcatggtgtagggatctttggacttgaaggtgaaatttcaaacatcttcaatattcattttggttctgggagaggtaggaaaactgtctagaaatggtccatttataatcatatatgtgaatagaacttagcattttggttggttggttggttaaatgtgtgattgtgaaatagggctatgatgagttgacataaggggaaatcgacctttaagtagggtgaccatataattttttatccaaatggggtcatgagagagggaagagtggtgctattaacattcacattgagacagatgaaaacattcacgtccagacagggaaacctggatgtgctgtcatcttatgagggcttgtcatttgctaggaacaatttggtggtcgtttttccttacacaacaaggagagaccaggagcctgccctcttggtagatcagctaaacatgtccacaggattttgcttccaagatgaacatgggtgtagctttcaggagtgtccatcgagcatcacgattcgaaacctgaattttcaggggcttctctgtcttgtcaccttcctttgctgcatgcttcagtctctgcttgaatttgcacctggaaatggggttgaaatacatttggtgcagaacgatagcatttcaaacctgtctaaacagtttgcagacattaaaaaggatttgtatgccaagaaggaggcccctagctcatggggccagccccagtttgccttccgaatatactcattttgctgccgttaaagactttctgtgtaatttgagtcaaaatatccctattttctagttataccgattttcttcacttctaaaccccaagccaccataacacttttttcaaagtctgttttgctcttcccaccccttccagctccttgggggatttcaagatgggattgtggagcatagttaaatccatcgtaattacattcagtcagctgtatcccctcttcttctttgcctttgggatttcactactttaaaaaagtattctctgttgctgaacaattaaacataacgctaaccttgcagtcagattagccataatgaatatggtgtgggcatttgatactaagttacgtcattttaagcaattaaattaatatctcaaagtcaaaaagctaattccaatgattgctgtagacattttaagaaaatattttccaagagaaaagggatatcaaaatataaccatttttcttttgccaagaatacattgcatttgttttaggtacagataagaggcattttaggtatagattaaaatctgtggtgaggaaatgtagtcaagaaaagggctttacttgcactggagaagacttcccctcatgcacggccctcactaacttggagctgagctgcttgctgtacacgagctgtgcatccaagtgagcctctgtagtccagcccaggactgctatctgctgttgcctccggctttctggtcatgctgggggagttggggtaaacaggagcagcatctcacacacacacacacacacacacacacacacacacagacacacacacacacacagacacacacacacacacacacacacaaaacagctctttctgaggttgggaaggaatcattctttccaatggcatcgttgcccagcgttggccagactgtgatctgtttctgtccaagaatgaagacagctttccctttctaaagctgttctcagctgttccctcatttcacaagctgctttccagctctgatgtctgtggttgctgtagcagcaggctaagccacacctgacccacagaaggacatgaggttggttctacctcacagagagaagctgaaatctttgttcctattaacacaaagataaggggctcggaagtgtgcctgagcgaatgggactgacagtagcaatgacggtggaagaaagcccaagaacgtctccacagagggatgcctggcaacacaggagcaggcccacatggccagcatctctgaggtttaccttacccgcaacaggcacagctggcctctctgccccatgcatgacttgccacatccctgaaatacgaattgcatgaattttatgctggaacaagctgcagagtgatcagtcacatttgcagccctgtggactatggctattggaccgtacaattaaaattaagtttgacattaaatctaaaacaaaattttttgaaaataaaaaggctagacatggtggctcacatctgtaatcccagcacttggggcagctgagatgggagggtcacttgagcccaggaattcgagactgggcaacatagtgagactgtctatttttctttttttgagacggagtctcgccctatcacccaggctggagtgcagtggtacgatctcagctcactgcaagctccgcctcctgggttcacgccattctcctgcctcagcctcccgagtagctgggactacaggcgcccgccaccgcgcctggctaattttttgtatttttagtagagacggggtttcaccatggtctggatctcctgacctcgtgatccacccgcctcggcctcccaaagtgctgggattacaggcgtgagacaccgtgcccagcccaagactatttttaaaaaatacatttacaaaataagatacatttaaaagtaagttgtctcatctgacggcagccttgcctgggacactgctccaaaggcaatcttagcagggactcaaatctgattgttactgctgggtcttctccctgaccctgggaggtataactacagaatcattcatgcagcatttgcaacttaccaaagggtaactttccacagttcccagcgttagcttagcaaccagagctgcagaatatgccgtcctgggcagaaaagggaatggtgagtactgtcagttgagctttgcatcttctctaccttgttgaggacataacatctccatcagagattcttacaaacccaccaccccccgacacacccccaagaagaaaagcctgggaagttctttctacccacatgccatctttagaagttctccaactttatggtagaggtcatcccgtcctggaaatgtcagagaggaagattatagaagctggtcaggaacttaatgaacatttcctgcaatacactcattgtggctagtgtcaccaactttaacaagtgacattaacaagaggcttatctagctagcctgagtcagttttgtgcctcggtgtgaaagctatttctagtaccattttgcttatagccaggaatagttcatatcaaaactgtggaccagagttcatttttagaggacagagctgctaagcagaaagcgacagggggcccaacctcaccctcctagctccttccctgttgacttaaccttttgaaaacatagacatgggccaggcacggtggcaaacacctgtaatgccagcactttggcaggctgagataggcggattgcttcagcccaggcgtttgagaccagcctagccaacatggtgaaaccctgtctctactaaaaataaaaaattagcggccgggcacagtggcttacgcctgtaatcccagcactttgggaggctgaggcaggtggatcacgaggtcaggagattgagaccatcctggctaacacagtgaaaccctgtctctgctaaaaagacaaaacaattagccaggcgtggtggtgggcacctgtagtcccagctactagggaggctgaggcaggagaatggcacaaacccaggaggcagagcttgcagtgagctgagattgtgccactgcactccagcctgggtgacagagcgagactctgtctcaaaaaaaaaaaaagaaaaagaaaaaaattagctgggcatggtgacacacgcctgtaatcccagttactcaggaggcggaggctggagaattgcttgagcctgggaggcggaggttgcagtgggaggttgcagtgagccgagatcgcgccattgcactccagtctgggtggcagagtaagactctgtccccccacacacacaaaaaaaaaaggaaagaaaaaaagaaaagaaaacacagacaaattcaaagaggacatggaagcttaagctagaagacaaagaggaactagtgaggggtgtgtgacatcagccaaagctgttggcagggatgtgtcctagaaggcagaactttcagcttcctcaaggtcgttccttagtcgttgccactgaaaaatgggtctcgatgggactttgaaaaaaacagacccggcatctagtgagttgctgaaacttgccagctgtaagatctggagtgtttcttttaaactgtaggccggtttcctcatctgtaggattatgtcacactatctaccctgatttcataaggtaatgctatgtgagaatgctctcacttaacttggaagaaggtcaaagcaggatgatgttactttcctcaattctcttttaaagactttcttgagtgctggatgccatgagggaaagcgtatccgaaacactcatgtttctcatggcactgatctagggctcaggggactttgcacatcattgtgttttacctgatgtttaatcccaggcctgacagtggccctgcctcagatctcacgtcagatgggggcgggtggggaggacaaagccttccagcctctgtttctccagtgcagtcaacagaatgagctcctgtcccaagagcctgcaggatataccaacctgagagtcagacttcagcctgcagctccacaataaaaaaaaataaagcaagagtagcccctgcaagacgccaaaacaactacggagcagatcaccatggaaaatgcctcagccagacatgtccaggtccttcagaaacacattgctcatagagaaataagtttttgcaggtgtagtgagagtcaacatgaacataaaccaggcagttcgtcagtggccgattcagaagccggagccaagggtcctgactgagggaactgaggcacacacctttactctctgggtcttagctttaagttggggagagggtgggttagatctctgctttccacaagttctaaaaaatgttcaaaggcattaagtaggggaaagatgatctaataagtttggaaaattctggattcaatgcaatttgcttacttatcctaagatttagaagctattttaagctgaaattctccacggctcccagaaggggtgtgatatgcagttttagcccaaacttaccttgccatgatatcttctttccaggaacgtcagttgtgactgataacatgctggacccgtgttgggaaaactgaactggatgatctcaaaggccttttcccttcagatattctctgactgtgactgcttgaaggaggccaagaattagagtttcatgtcagaggccctcattgctaaagaagtagaggctcagtgtgattgggaaggcccacgtggaactaggtcatccccttcagctgcttcccaaccactgctctgtaattacaatgtgcatccaggaagttatcaaaatcctgtttggagaatattggattagcagaatgtttgattaaatcaataagtggaatactaaggggtttttctcttactaattacatctggaggaactaacctcgtctgtagggatagactaggaagctatgtttcttatgtaaatgaagatagcctaaggaaaaaatatctggaaaaggtaccctttcaactctgatttgtaaatgtcaaatagaggtgctcaaggagaaaagaataaacaatttcatgaaactcaacataaattctaattataataggaatagttgaattcataaattgtgtactctctgaaaagttaaatattagcctgaaaatacaaaaaggacttggatatttcatttttacactcttacatacacacaactttttcctcccaataaataaaacgatatttttgagggacaaatttggcaagttttgcagatgagggtgagaccttattcacttcctcctaaatttaacctaggttaagaatattttcagtcactatttgttgaattctaggtcttagtgttctacctggtcacaatttgtattgagacagaaaccagtgaactcaaatcttcatcagccctcattatcagaaaactttggctggacagctgattgatttgctggttttactgctggcttaatattgatctgactatgtatttcccttggctcgctaaatatatacaaatcaagagaggtttttgatgtcttaaaaggaaacgagtaactgactagagttattgcctaagacccaatatgcaattcagcttaacccacagggcacctgccatgggccacttaatgaggacaccatccaccactgctcatgctgcaagctgccaatgcccttcttaccccttcacctcatttaccccattatctgtaatctgaaattaccatcacctcccctcccactatattttttatccctctcttcttcctcctcacttcccatgacgacacctctgcttcaggtcctcatttcggttcagtagtctcgaaagatctctcttcccattctttcttcaaatgcatcgtgtcctcctcagataaaaagatctttcttgtcttcagtgggtttccactgcctaaaggataacatccctattccttattcatcaaaaaatcttccattgggtggccctgattatctggctttatccctcactgggccaccaggagatgccacacgtgaaaccacatggcacagctccccctcccggtatatacagcacgttgttgtgtctctgccctttggtcaatagtattctctttccaagaatgccttccccacacttttcttctagcaaaacattgctcattcattcaagcctggctcatgttgctcctctgtaatgctatcctactttgccttaaatgaccactccttcctttgtgttctgcactatattgtttatatcgttgtccgttggattcatgcatgtctcttttgtcactagcagtgatatacataaacatcccaaaaaaaaagtagctctgggacaggaatgtgtcagaggccttagaaatggtattttatttagtctttaaaaataagtcatgttattatatacctcatagaaacaggctcacagaggagaaattgaatgccccaggtcacatagctggtcagcagagctgggattcaacccagctgctccgtgtcaccctttgcattgcttcctgttacttctccactgttatcccacctgagcctgtgtgccttcctggggattagtcaatgtgagggtggctccaatactgtgtttctgttgttctgaagggctctgttctttgttcatcctttgttaggagatgtgaagacattctgagggagtggaagataggctgcccatcctcagggctcaagagctggagagaggggataaatgaggaagtgctttgaaagtggacacaggatgacattagttaggcatgaggcataatactgctgggagaatacaggaaagtcattctccttcgacttcctcacattatagtttttgtacaatttggagttaatcaaagagtagataaaccgagaaaaatgtgtgttcaacaggaaaaatggcagggtggggctgttctaaacctggggcagcagttccccactgtatctgggacagagtcatttaatttcagtagtggcttttgaatctgtgaggcccacttgatcttctactcctatcagctcagtgactcattctcccggcaaagacttggcgtcatcccagggaggcagagaggccaactcagtggtacccacaggaccgagtgagtctctcacaggctgcatccacgccccccatggcctctgctaatgaggtccacacctctgctcagcagcctgccaatgtgatgggacacaccccatgctggaagagctcccaaaccagactttgtggaaacttgtggctgcaggttcaaaaggctaatttggttttccactgtgcacagggctgccactcagtgcagtcttcagattgagaacacttcctcccactatgggcagtttggcgtgaatgagtgagatacgtagtttctggatagcacccaggggaatgccgaggatgtgcacacaaagcaaggctgactgttcctttgctgtttgtctactttttcccattttgtgctgagactcatctttccagcacaaacaccagggtgaggaattggaattttagtgctggaagtctccagaactatgatctagtgctcattccctctgatcccattgccctgacattatctgatgcttccacagctccttgtacagggaggtgtggagttgggagagcagcagcctgtggtacagggctgcccacagggaaggaagaagacatggcggggacatggcctgactcccgatgtgctccttcctgtagggtcttccacatggctgggctccctcccgtcccagcacacatcctgggtccatgtgaccttgagcttcacaaggtcaaatctgtgcagatccaaatggtgtgtggatctaattttcttcctcaagaagccttgcacaatctggccctgcatgcttcctctgagcccacacttcctgtgagcatacacttcctgtaagtgtatacttcctttgagcgtacacttcctgtgagcttacacttcccatgagcttacacttcttgtgagtgaacacctcctatgagcccacatttcctgtgagcccacacttcttgtgagtgtacacttcctataagtgtatacatcctgtgatcatatatttcctgtgagcatacacttcctgtgagcttacatgtcctgtgagtgtatacttcctgtgagtttacacttcctgtgagctctcacttcctgtgaacccacacttcctgtgagtgtacacttcctgtgagcacacccttcctgtgagcttacacttcctgtgagtgaacacttcctgtgagcccatacttcctctgtgtatacttccagtgagtgtatacttcctatgagcccatatttcctatgtgtttacctcctgtgagcccacacttcctatgtgtacacttcctttgagcccacattgtgggtgtacacttcctgtgagcacacacttcctatctgtgcacttcctgtaagcctacacttcttgtgaatttatacttctatgagcccatagatcctatgtgtatacttcctgtgagcccacatttcctccgatggtatacttcctgtgagcacacacttcttatctatgcacttcctataagcccacacttcctgtgagctcacacttcctatgaggccacacttcctatctgtgcacttcctttgagcatacacctcctatctatgcacttcctaagagagcatgcttcccgtgagcccacatttcctatctgtgtacttcctgtgagcatacacttcctatctgtgcacttcctgtgagcatacacttcctatctgtaaacttcctgtgagcatacactttctgtgcacttcctctaaacacatacttcctctctgtgcaattcctgtgagcccacacttactatgatatacacttcctgtgagtatacacttcccatgagccccccttcctctgtgcaattcctgtgagcacacagttcctctctgtgcacttcctgtagcaccactttctctctatgcacttattctgagcacacacttcctatctgtgcacttcctgtgactgtacacttcctgtgagtatacactttctgtgagcccatgcttcctctctgtgcacttcctgtgagtaccactttctctctgtgcacttcctgtgagcccacactttctgtgagtgtacacttcttatgagtatacacttcctgtgagcccacacttcctctatgcacttcctgtgagcacacacttcctctctgtgcactttctctaagtccacacttgctgtgtgcattctcacctgcacaatcactcttgctcttggggttcttgcacatgattctttaccaccccagaactctggaaggtgttgctttctgagacctacctctcttgtgtttctccaatgccagttcatccatagatttcttcctaaataccactggcctccctgtgcagtgctttcactgggacctgtgttttttcttggtggcacttacatagaaggattgttgtttaatgacagtcgactccaagactgtcattggtagatggtggcttccaaaatggcagaaccaagtcagccttgttctttgtggtatctccagggtcagccttccctggtgttcccaaatgttccctaactgaaaggatgtattacagttgggcttcctctccctaggagacataattaaatttaaaagtgggcttgggttgtttgtagtatgcagttttttacaggggaaccacagaatctttattccagatttttgaaaaggtgcgcggtgcatttcatttagtccggtaagccgtatttttgtgttctgttgtcaatacattttcagacacacatcacttgcgaaactcctaaaatcttttcaaaatgctctcacaagcacataaacacatatcttcttccttattactcaggcacttcagacccagagaattgcttttagagatcttgatcataatacctcaaagacagttttctttaggaagataaagaacactaaaatgttaataatagaaccttgagaccctctgaaaagaagacttatgtcagattgataatttaggtagagttctggaaaacattaatctacaaacatatgcctgatagaaggatatttgcagaaatggctgcaagtgcaatattgttccagctggtgagtgtggtccataaaaattcagtctttaaaaattatagtatagtctaattgtaggactgtgtgctcagtgaaaatgcactttacctatagatagggttgggagaaccaccctgtcttaccacagtgtatgtctgctcaacacactgccatgacctgggaagagaactttagggggacattcttatgaagcccttccctatacctttttgttagttccttataatcccagaaattttttattagggtagataaatgaccataaaacgtttccaccccgttgaggatgtttcttaggacttcttttatgacaaccatctaaactcagccacatctgcctctggcgtgtctagtttggggccacctctttgcatccccctgtgtaattattttatgagtgaagtccctgctggaaaccagccctcttcccagtcaaaatccatctgtttctccactgcctgtacatgcctttctctttacaatacagttagaccatttgagtcaccttctctagagagataacacaaaagcagaatcacagacatgtgcaatcttccagtaaatgtcttccccccatacaccatgtatggggttgaaaaatggtatttctataaaaaattggaatctgtgaagacagggttacagtgagaaatattaatacacacattgcagagcaggctggtgtcaggttctgtgccaagggtctgtggtgcctctgacaaaggagaacaatgctgaggggacgaagcagcaggaggagatggtggggggggtgggggggtggggggggtggggcgagctaattatccaaattggaaaaggcccaagccccttggattaacacacatcttccctgctgaagaaagtgctcagggaatgatcatgatcagctgccatgacctccacttctcctctcacagggcaccaaaccaacatgcatcaggtggatggctgttggtgatttacatgggaaatgactgtggtatgcagggatgcaaaatcagtgtggcttcttcctccagaagtatggggccacccttgcctcaactcataagaatacactgatgttctggtgttgcctcagaggccttagcttacacaattcctggggtcagggttgggtctatccaaccctagggtgtttctgcagaaaaacatagaccagtgttcctaagatgccagcctggcttctgctcccaatctgcttcctctgaatcatacctcttctttgcaaacgaggtgtttttgtgaacagaaaatatgtggacttgactgcttcatttactctctcagaagttcattaaaagcttacatacacaccaatcaaggctttttatgagacacagccaagatgttttatgtgtatggtgccaataaacacacttctccagaaggaactagtactatttatgtaaagtagacacttaattcaactgaatggaaatagcaaattagagaatgcttgattatggcattgaagatgctttctgggatgaagacattatttggaaaatctccagatgctcaaagcttgaggaatgctgggatcaggcaggtaactctgtaatagaattggacagagactaattctgctcaagaacagctcaaatggaaagctcagatccacagggaaggagccaacccagtccctttaacttggctatggtggatcaagatcgtcactggaactctttggttgtgagactcaatatttattctgtgtaggcaggagcatattggacccatcatgaaactggtactgtcataggctagacctgtgacctcctaggtgaaataacaaaggctggaaagaggtgtccccatgggctttggggaagacttctcttgcccaacagtgagcttgagcaattacttttctaaattgattggtttattaaagaaatattaattggacaagacaaccatcaatgtgaacctagttcaacacaaagaacattcaggccatcagatgaccaaagtgaagcttcctggtacttagcatctgccttatcaactcaggcctgacaaggaaacatgtcagttgctggagaaacacccataccctaaacacctcctgtcacacagtggcaacctgaattactgtgaatccatttatgcggctctcttctctaagagcagaggaagtaggtgtggccagactcagaggaggtcctcaagcaggaggtgtacaagtcagggttctccagaggaacagaaccaatagaaggtagatatagacagatacagatatataagaggggatttatcagaggagttgtctcatatgcttatggaggctgagtcgcatgcaggccatctgcaagctatagaatgggggaagctggcagtgtggctcagttcaactctggaagcctcagaaccagggaacctgaaggtgtaactttcagtccaaggccaaagtcctaagaacttggggtgccactggtgcaagtctcagagtccaaaagccagagagcctggagttctgatgtccaagagcaagagaagaagggtaccctagctccaggagaatgggaaggagagggcaaattcacctttcctctgcctttttattctatccaggaccttaaagtgattctaatgccagtctcttctggaaacatcctcatagacacacccaaaataatgctttaccagctatctgggaatcccttaatcctggcaagttgacattggttaataaaattagccatcgcagtgggtcagggagaaggtggccgagtgtctgcttcctgtgcggagggcaccacaccttctgaatgacttcttggtccctcatagcctaagaagtccggtgaaatgcatttgatctcttgactactttttaccccatcagttgtaccatccaccttccagctatcttcccacttcatgcccatgattccatgcactatttatgctggagcactacaactaagaagtctcttttgcatttctttcttccctccagcaacacatggccctttatgcagctctcacagccagtctgtatgagagacagaaataatggcattgcccttgggaaaggagaaacagataaagattccttctcttgacttctagcggcaagcagtgacaaagtgccccacaaaatttaaagcatcaaggagtagcccgtgggaagatatccatcagatcctccaatatgtgaattaggtctgatggggggtagctgctcactggtcatgatatcttgggactcctgcttctatccagcccctacatcgctctttcatgattttaaatgtgcactcaaggagctcactccaaatccaagcctacatgtatgcctaacctactccaaccagagagctccatatttatgtgaagaaaagggccatatctgattaaacaaccatgattctgtttgcaaacaccaatccacacattatgaaagacacagcaaatgtccccaaataattgattttattcacaccaagtttactctgacggattaccacaagtaaacatgtaaacatgggtaacacttcactatagtatagttcatgccacttgcctgatagaaaaccatggagcttctcttaggaatccattttggttttggggtttgtttgtttgtttatttactttttttatattaaaaagagagatgaggtctcactatgttgcccaggttggtctcggactcctggactcaagtgatcctcccacctcagcttcccaaactgctgggattacaggcgtgaaacactgcacccagccaggaatcctttaaagtacaaggaggattcagcttattatagagccagtctatacacaataacctgaattatatacctaacatgatctaaatccttagagttttagaaacactcaaaaatttttttaagcctcatttctaataataacacagtgattaaccacaatgcttggcgaattgcctcaaaacctttttggaagtagggaggatataaataaatcagttaatacataaataaaatgcttgcagctcagcgaccttctggttctcaggtttccatatatcaaattatggattgaccccgctaagtaatctccgaagtcttttctatgtagaagtctataaattttctgttaatcccagggtgagttggggaccattttgtcttttgtccttgtcgactgtctttgtgagaagctgagtctgcttacctgctgggttcagtgagcaggtatgaaggcatcatgtatggacattgaagagttgcccagagataagctctcacgtttggagaagcatgggtgtgtgggctactgttggcttcagcttgtgtacaaggatattcaattttagaaagccataattaatagtttctcttcttaccatattgaagaagtcagcttgttgccttctggcgaattaaaatttcattaaacttttcagttaagaaaatacagcttgttgcaaaaacaccatatgcaccttacgactcttttccccacccctcctcagtgcgactcccatcactgcacaggtggaggcagtgaaggggatgccttgctttctgagctgctgaaaacatcagggtttcagttctgtcttgtttactgctctatctgatcaccttgcattgtgcttggcatgtagtagctgctcagtacataccatttgaatgaacaaatcaatcaattaatcagttaatcagccagtcgatgcaggtgatgcctgttcctaaattcctttggtcccagtaggtactttgcaacatttccctttcttctgcttctgttagaagggacctttttaaacttgaagggcagaggcccccacgcagctcatgcagatggtggtactaactggagaagcagttacagttgtacctagcatgcatttctgttggagctcatttcaagtaaatgacttatactttatgtccacagcaaagaggcccacatttgtggcaatcttggtcagtacagtcaggaaggaagtgtagctgaagatcactgaggaaccagagaaattagtgtatatctggatttaatgatcaatttgcttatgttaaaaatacatttgaatatgatttactgcccttcagttaatgctagttccttgcttgcagcaggaccaatcaaaaggagctaaaccttaaaacccagatggagatgttgaaggattctagctaaagtttatgcaattaattaggcatcccctattcagaatacactttctatttgtgcttagaattgaaagatatcgtactcccaggaaaagtacaaagaggaccacgagatacattgataatgaccttatccttaattcattccacacatactcagttaagtggcttaaataagtgatagagattttaatttaaatgcgagaatataaatgggcaaatatttgaatttaagtgaaattaacacaacgtgccaaatattgaataagaaactggaatttagttggcattggataatgtatttggtttgagatttgggtttccaaactgaatatataaatcaatgggcagatatacagtgaacacaaatataaataaacacagttccatgtttactgtttataatacgtccccccaaatatgtgcagaagtggaatgtgaagacaataaacaacttttttgttaggttgggggcaggggattctgaaagctacaaaatatcaaaccatttattcattgcatcccatctttaagatacagttttcatcaatatattttcaatgtttatacatgttacttagttctgttctttttctactcaaatgattgtacagttgattaatgtcacatggacttccattgtgattattcttttagctctgcctattcacattattaataaaaccatgaaaattaaattaatatgaccttatcattgtaatcactactttcatttttgcatttttctactcacttttaccaaaaaaaaggaacaagatgggaaaacaaaaattacataaaaacttcagcgtatggggaaaaacagagttgtctctaaaaaggatctgctctcggcatggtagcatcagagcatctactcaattgtcagccataaatgaagttcagaattggacacaccttcacagtcttccatatgccaaagcggattgttccaacatcagatgactccctgccatgtattccttgttagtttcctatgctaaatactagtaagataccaaaggatgttagaaatctgaggagaagttgcctaggatttagagatcactcctagtctaatatcagtaggtttttaggattacaggttattcaagggctgcttcctgtgtgtagaggttgtattatgagtcctgaaaggagagagaggaaaagagtctgccgtattcagaataaaaaggcaacaaagacagagtgttttgcggattgccagataagtcttttctgaccgttcccaatcctgaaagttctaacatggagactgcttggtctttgaaggaggtgaattgcagtaaacaaatcatgaattatcatctgcagtagatttgaaagtctttgagtgaatataactgggggatgtaaccttaactttcagataagtttctaaacagttcagcatatcattttaaaatgagcaatggatgtttaatgaagaaaatatgaaattcaggttatcatgtaaattacaggtaaacaaacaaaagggaaatacaaaagtgacctatactctaatcacccaaacagaatcactgttaacaagttggcaaaattctttctgggatttcctaggcatctatagtccaacttagctctatgtttatttaactacatttatgcatacaaatacttttctttacaaaatggtgtgactttattctgtaacctgctgctttgcatagaaataaatgatgagcatgttttatgtctctaactacacatttatcttgtcttaatggctgcttggcattcatttcttgggctatagcttcacagatttagctactagatagtctccaattatacgcaatagcacatatacctttgtgccgttttttgtacatatatctttgtacattcattaaataatttccttaggataagatttttcacaaattaataggtcagaagtatatatttttaatacatatgaggtgtgttggagaattatcttttagaaaatttatatcagtttatattctcaccagcagtatatgagggaatctgttctaatcagacattctcaacacaaggctttatcattctttttaattgttgccaacctaatagatggtagactctactaatttgcattttttgattacttactaaggttgaatttttttcatgtttattgacctttttctcttgcctctttgtgttcatttagccctggtatttggtatgatttctcctaatgctttgcaagttaataacttattcattaattcactcatttattcatttattcatttacttatctacatctctttcttttctgtgtgttgtaatctcatcccccccatactctgagctttaatttgatttatggtattttgtggcatataaaaatctttccgttttatttagccaaatttaccaatcttttcaattataattttagacctgaacaatttgggatctctgtgaattcagttattcatctgcatattcaagctaaaatagagcagtggcttagaaaccatctttcctaaaactatgacaatgccatttacagtaagagtcaatgaaatggggggagagtcattcaatgttcagaatagaaagatttagaagaatggcaaagttgagcatcatacctttatgaagtgaattgtgtccttctcaaaatccttgttttagccctcacctccagtctgactgtatttgaagataaggcgtttttttagggttacatgatgtcataaggatggggccctaatccaacaaaactgacatccttataagaagaggaagagacagcggagcttgctctctctgccctgtgaagacatggtgaggagaaggctgtctgcaaaccgggaagagagccctcaccagaaaacaacccctccagcaccttgaccttggatttccaggccccagaactgtgagaagttaaatttctgttaagactcccagttatggcagccaagcagactaatccacttaggctgatgcagtcaccagttctgctgggcacaattctaagatgcctcccaaaatgctcacttggccctggcgcctacacaccatctcccagttgtttactcaagcactgatttcagtgctgctgcaatgggatttggttataattaaggtcctggatcagttgccatccaaatggggagataatctgggtgggcctatttaaacacatgagccttgcttttagaaagacccctacagctagtcacagaggaggcgactagagagactttggatggcctctaggaaagcagacctccttgtcatgaactgcctgggggccacatgtaaagagctgcaggtgcctctagctgagagctaaaaggaaagaaagacccgagtcctaccaccacagggccctgagttctaacagccactgagcttggaagaggactctaagcccaagaaagaaatatagcccagccaaactcatgggaccctgagctgtgagtccgtttaagctgagcctggacttctgacccactggaactggaagataatgcatttgcattgtcttacactggtaggtttataggattttgtcacattgaaatggagagtgaatgtgtcagtgtttacatccctgcggagcaaggagggtgccagctacggaggtggagtagggggcctggctctgcagctggggcatcgcagacagcggtttggctaacggtgcagctgatcttcgcaagttcccaccctgctcctcatgaaacacagttgcgcctcgaacaatatgggcctgaactgcaagggtccacccaatgcatattgaaaatacagaattgaaggaagaggaaggggagtcccgcatatacagagggctctcccatacagatgagtggaaatgccaccgggtgaaatctgttggaacatccatacagaagcaaaatattagggaaacaacaggttacagaatcctccttgaacattttttctttcagagaagtcaagtgtgtaggtatttggagctaggctaggtgataagagggacgtaaggaatgtggtgtctgtcttacatgtgaatattgaggacccagtatctacagccacaaagtgacgaccaggtatcacccagcagcaaacttctgaaagtcacgctctgagaagcctctgcctccgatctggggccttcacctttccaggggcccaccccatccctcctcccagccttctgctacctgtctctccacttcttctacaagcaccctctccaaaactgccacatgttctcctgactttgtgtctctgtgggattgcctctatgatgtatcaggaggacgtgtggttcaggggccaactgaaacaccatgtcctttggttttttgtgaagccatcccccatttcctggaaccaaaatagatcccacagcacttcctgtgtaccctgatacctaacaaaatgttttaaagattgctttagctggagattcttacatatgtgtgtcctcctgggacagtgagtccggcaaccaaccctcgctgattctttccctccctccctgcctctcgcagcagctggccaactgccccttctccagcaggtgctccctgcaggcttgtgaaatacactggagggcaattgtctggctcagactcatgttgccatcagcaaatgaccacgtttaagaatgttatgccacctctatatttggcctgcattattcatataaatatgcttggtagacaagggacagaaggcacttgtgtcggagaaagacagtttaaagggcaacgacctaacacactataaaatacagggagtggggagtggggtggagggagcaagccgcgcggctgccaggcagggccctgctcccctgggtgcacttcctccctgctcccgtgggtgcacttcctccctgtccagggagtgcactcgcttcattgcccagtgcgactgggtctgctttgcaggggccatatctgtctgattgtgcttgggcagatttctcttgtctccacctagctggggtgattcaagtaggaaaaaagaaaaccctcctgcacagattgtgcgatcatttcatttccttgcctttgtttgtcatttctcctgtctgaaaaaacagggaatccactaaaggccagaacattgtactctgcttccatcctcatgaaatcttggcttttctttgcaggaagcgtccaaaataacacaggattggtcctggggtcccaggcaaaagtgagaggtcagaagggtctccatggttctcactcctctctctgtgaccttcactagctcacttccttcctgcccagttctcattctctcgtccagtcttttctttgtcttcctgtggatgaatacatgcataaacataagaataaaggcaaaagtctcaatggaatctatcaaactgttcattgttaaccactttcctgtaggttgggtgggggaggttttactttcactttattcatttccttccttccttccttccttccttccttccttccttccttcctttctttttctgtcggagtcttactctcgctcagactggagtgcaatggtgcaatctcagctcactgcaacctccgtctcccaggtacaagtgattctcctgcctcagcctcctgagtagctgggattacaggcacccaccactatacccagctaatttgtgtgtgtgtgtgtgtgtgtgtgtgtgtatatatgtatatacacacacaaacacatacctatatatatatatttaatagagaaagggtttcaccatgttggccaggctggtcttgaactcctgatctcaggtgatccgcctgcctcagcctcccaaagtgctgggattacaagtgtgagccgcagcacctggcctattaatttctgtatttgattttttttacagcacatgaaatagttttgatgtttaaatgaaggaaacaaaagcagtgctttcgatagcccaagcttatctttcctaaatgaacccaaacctcacagttattccctttacttcccactcccgatcacacttgtcccaggtggatcacgtccgagaccagcactccatgaattttaggagccagagcggaccgtgaaggtgtcctggtagctgaggtcctatggccgctcatgaaattttagtgagccatggcttccctgaggctgtggcccgcaaagtctgaagggagtcacctccttcaaatccactgagcaaggcctggggagtaatgggaggtcccccgtctgactcacacctgacagtcgggcctgtcccatctctggcaccagcaaccgcccggggacggtgagggaccatggggtcagcctcagactctctgcacatgtttgctggccaacgttccagccagcgggcctggactggagggctgggatggagagggtggggcaggaaggcagagcctgccctgagggaaccgggaggtgttccgcgcaggctctgctgctttctgacgtgtgaccgtgtgcacaggatttgtcccaagtcccacctgcctcttctggaaagtggagcgatgatgtgagcaggcacagaggtcacaaggagaattcagggatctagagacccccagagcttgccctgtgcccatgctgcagtgggcactctcctggcatggccacgtctgtcacgcgtgatgctcacagcctgctcactactagaaggctttaattttctgaagcagtgatatttaatttatttgaaatttcaaatgtcattaaaggagacgtgctatttttaggctaggaatttaaaatgcttccaaaatgcctcatccccatcgctcttattgcaagcatgtattagctgttctcacgcctgctgagaatgccctgtgactgaagcaggggctgcttctgggggacagtgcagccaccatgtgggtcaatataaggaaatcaggatgatacaagtgatgtgggtttgcaccatcatcctggctgctctgtgtgctgacgtgtgtataacattgacacgaggatgcctgtagcagatgggggtttagctagaaagcaggaggcagtgcacgatgagtatggtgcagtatctccagcagacctatgctgggcagaaacctcacagttctgtccaaagggagcttcatccctccgatggccattcccctgcagtccgtgaacccccaggatagctgcaccgcatcagcagaacaattgcagtgcctttacagtgaaggaacacaggctccagctgtcagctccatctcaaaacctacccaccccactcatcctgcacacgctgccccagccccatgccccagaggctgcccaagcacctagcgaagccctccaggatgcttggctctgggcctgttgtttcaagccctgccctgccttctggctgctggatggggaattgcagtgagattccttccctccgaagctccatctggtgcaacatctggagctggtcccccagcataggaggatgtgagtgggatgatgaatggcacctcagaagtgtgctgttggggagggcccacctgtttaccaacatgattgcaaaacttaaatagctctggggattctgaactgctcttcttggggggctccccaccgagagcattttaggccctgtgcatagcaggattataaaaaagtcatatttaagacttgatcatgcttctggcatttggaaggaaatggatggatgaagaagaaacagaaaagattatagagaactggaaaacaacaatttaactgctaggatatgaatcccaaatgttataggggaagttctgggatgaagagaagacggagcaatggctgccactgactcagtgatgtgtaggacatggggaagccgggattgtggacactccccaccgtggtaccccccgctccagtggtaccctcccccgcccccggcatgggcagctcagaccaccgggaaagttccagcaggcagatacattgcttcccacacaagctcattgggagaaggcggctctttttttctcattgttacaatatgatttgattcgtggtgttgtaatgattagcaagcagaaccaatgtggtttctttccccagcatcgcttgaatctacagcaaactgtccagagaagggatcacagtgggattctgatgccttattatgatgtcaccttcacgaggaggtttagaggtttgcttttgttttgctgttctaagaaaaaagaatgtgccatttggacatttcaccttcaatttggaacttaaaaatttagtccataaacaggaaataaacagaacttttgagagctccctctctcatttggcaaggccccccacttgccctcagcacttgggcacccaccttgacttacagaggaagccctggaaacagccaaggatgggggaaaccaatcctgggagcacaggggtactcgcctgccaacctgctgacctctgggaccaaataccagggctccgtggagacatggctttttctgggaggatatactgaaaaacagagcaaaaggggaattgtttgctgtgtgagattgccaagtcagccctaggaaagaaaggcccaagggcacatctgcagaaggactggagggtcagtctgagctcatatttgccaagtctccaaagaataggcatcttatggtctcagcacgagggagaagagagaatttcacctaggatggcttccagtaagcacctgtgatgtctgggttctctccattcccaggcctgagagcggctgcacagtcctgattcctggagcgctggcccaggccgggtcctccatgtcaccccctttaatatctacatttattcatgcagacgcggactctgagcaaagtatcaggagcctggtgattcaagttgggagaatccaccaaagtgctttccccaccaggattcactcacttgggcctctttggaggctcttcctccccactctcctcttaaaggccaggagagaggctggcaaggtcgcctgtctccctcctccacacctgttcctagatagctgcttcctgccgggactccgtgatcttgtctgcaatgggtccagatctgtagactgtcatctaacccctagattcctacagcggactgactaccattgtccgtgcatagcaagcttgtccctaaagctcagacgatggcctccccagtgcttccccagaacccgatgtggttttcagtagaggcttcttccatggaagctgccaatatgtgtcccacctgccggcattagacctggggcacctgattgcttctgcccgccccaggatgcttgccccaggcctctcccatccatccaggtcacctcctccctagaccttctcagcagcccctggcttgtctctgagctgcgggctttctgttcctggactgcccttcaccctgtccccagagcctcctcagcactgatctgattttgtcactgcattcctgtgcttgtaagcctgtgaccagcaatactgtcacttcttagaaaacattttggtctcgacacggttcacacaggcaatgccccgccatcattgcttccaattgtgttcgacgggaagcagacagtagcagcgacggctcttggtgctcacccagacctcccttgctgggaggttgccccaagaccctgcagcctgttactgatggaggcaggtacacacatagccatccccttgccctccctcagggaccagctgtgaagtacagtgcgtgcgtgcacttccagatggcattcgactgcagctggtctccagttgggaccacatcagtgcctcccgtctcccctaccccaggccacttccctccctcctcctattaacatcatgctccccaataatccccacagccccgcctcagcctctgcttctggggaacctgacctaaggcaacagcaacatttccctggggctgaggaggcaggcatgcttttaaagaggcttttccatcacctttgagcatcacctgcctacgagatcaaccccacacatttgagtttggcacatgacacattgcacggcctggcacggcctttctttcctgccttcatctttcgcctctctatgccctgttctttgagcttagcctggggttctccacagaaaccacactgttggactcttttatgccttggtgcatcctagatgtcacattacagtagtttggagagacttttcttaggtgtaagtgagataaaggggttgctggaggtgctggctacagggcagtgacagagaaagcagtggggtaggcttgccacatggaagagagcaggtgaaggaggagacataattttttcacaggaggcagctgctgcctgtccagcacatgaaccaggggtacagggatggggtgcgaccagcagctaatctaactggtgtatcttcacattgcatgttaccatcaggatggagagagcaggtgctctctggaccctctgtctcccagcctgactcttcccaagactgtgagcacctacagagcaggcctcaatccataaccttggtattcttgtgttgagttttatgcccgctgcaatgctagactgagatgcctcttgtatggaaaatatttcttaggagtttagcaaatttatgtcattggctgatatttcaggccaatccattttgggattagaacattatcaggatgtaaccttagagttcacttagttccggcaaaacctcttaacttcagttccctcatctataagaataagggattcatttgtgatcatatagctcaggtaatccaggaccagaaacccaggagcgtgggacctgatccacagctagaggatgggggactctgtagctacagcattttcctgaacacacaagaaatccagtaagcagcacacactggctgagtcggctttccaatcagaaacaagcccttgacttgccggagttggaagactgcaagtacctgcccaaatgtccacccaacagataaactccctgttacgtacataattacaagcattctttacctgacagtcccatggctggacaagccaagctaagttttcagtgtacataaaaagcataaaacccgatgaagtggcctgcctaaaaattaatgtgatggccgcaattgcagcttttgtggccctgacgttagtctttgaacgagtctgccttctgggtcaagtgaacttttactctgggattatagaaagcaaagtaagtgatctcaactccctgccgcttatacaagaggggagttgttacttttactttattttattttaagatggagttttgcttgcccaggctggagtgcaatggcgggatctcggctcactgcaacctctgcttcctaggttcaagagattgtcctgcctcagcctcctaagtagcagggattacaggcatgcaccaccatgcccagctaattttttgtatttttagtagagaccgggtttcaccatgttggtcaggctggtctcaaactcctgatctcaggcgatctgcccacctcggcctcccaatatgctgggattacagtagtgagtcactgagcctggccttattacttttagataaaaggcacttgttacatcagccatttcacatccattgataaagatgggtgcttctgaaatggccacagctgacagccaatacacctgcaggtccaccctctgctggtcattttctgaccacagtaagtgctcagcagccatccccagagcaggggtcagcaaaattctacatcaagggtcaaatagtaaatattttaggctttccaggacctacagttttcctatcaactactcaactctccttttacttgaagcaatagtcaacacatagatgaacgggtgtgactgtgtaccaataaaactttatttacaaaacaacagcaggccccggggccatagtttgctgactgccgccattgtgtagcctgaagtggagctcagaagcaggggctccagccgtgggtggcaaactctcaaacccaatgacaccaacagtatctttggttagagcatttagagttttagccatagttcaattagcagctgatgatttgttcctcgatcagcccaagcatgtgaaacataattgttccttcaattcccatcagccaggaggtgacagggaaatgacctattagctgacttcaggcagcaggaaaagtccaaagttggctgctgccattgccatattgattggtgatccaagagaagtgtggtaactatgaccaagaagaaaaggtctaggggaactattccttatattgtggaaatattccatacttcgctgggatattttcactgaaatcgttttgaactgagaaccagggccattcctctgactgtaaagctttgtagaatatattcaattctgcatgttactgatgggtgctaaccttttgtgtgtgtttgtgtgatgttcgggcttaagggatctctggacaataataatgataattcagctgcctgggatcttgatgaaacccatccactccttcccacctttcccatgtcagatcttctacaaagcaaactgatgctttcagtaaaatattactgatgcaatccaagaaacagaaaaaacagcccaccaatttactcccatttgaacccctgaagcctgttcacagtattaccacattgttattgaagtttacagaacaaaaccatagatggaacccaagaattcttctagttcaagcccattttagagctagattgactgaagtctaaggtgatgtgatctatgtgatttccccactttcaaatatctcctaagaaatggccatagaatgtatgagatttctttttaaaagaactttactcatactgcatacatgcatgtacacacacacatgcatgcacacacaccaaagctcaggatctcctttgaaggagtgtcgagctcacgaatggtaagagcccgtgtggctcaggccctctgcagagccagggcagagagacagatgccattttggggacaatttaggctgcacagctgctctctctgaactgccaacagctgaaccaaaatgctcaggaggtgggctgggcagccctgggctgtgggcacagtgtccttgggtatttacaatccctcgatccttgcctgattggttttccataggcagggcttcgtccaagttcctagggtcgcaataccattctcattagaaggttcctcttgagagacaccatggagcagggaaggtcttgggtgtcctcccatctcatttgcccttcccctaggtgcctgtgtttcccatcccagtggggatccaaagcatgtcctgggcattgggtaagggtttagaaccttgtccccgcctgcatatgatagacatggggagggacaggatcaggaggttgctaggtagagcctgcaggtgcctttccctgaactctgttatgtggctgagttcttcagagaaatagtcaggagctaaggggttaaacaagcatccctccctgcagagacaggcaggtcagaggctgcatctgttaaattagggtccaggccacagaggtaatacctaccactctaaactgttagccttccaatactacactccagttctgggagtgagtaactgtgtgtccagagatagaagccataagcacttgagttacagaactgctgagaaattggtctgatggtctagtagccttgtgccaggagaacagttcctatgtagaaactggtcagcattttcttctgaaaacgtaatcatcattgcagtgagtataaacttccatttatatgccaggaacctataagtttcagaatgtgtctgatccctgaagatgtcccttctctcagacggctggcccttgccccactgttgctgggttgtgtataatctgtatgtccagtcaacctcagctctcagcctctgagcccaggggacagaaggccgtggctttaaatgttcacttaaatattgtcaaggtagtatgtttattgtgtactcccaatggttgtcttagaaaaccaaggatggtgtcatccttagacctaaggggccccaggcctggcagtgccttccttcagagttctaagctccaatgcctgtgtgtggcctggctcacagagccatctgagcaggacccctgagcccagcctgtcttcccctcttggatgttctccaaccctccacccacccgccccatgcatgagtcaaccagatgccctgaggagctctgggacttgcacctacagggtcatcccgaggccctgtggccagataggcaccaatcccaggagagtggggaggtgagctcatctcttttgcaggccggcatggtatttctttggcaggatgctgtgagactgggtcccagaacagtgctggcctgttcattttggatgactcaaattgctttttaaacaggagtcctgaaaaaagtatttggccaggcccagagtactataggggcagccctgaccagggaaacattaatataccctctcccaaaatacaaatctcttttagactgttgccagcagtctcaggaatgatcaatactagtggttgagactagagggaccattaagtaagtggagttgatctttattggatatagctggccctctttggtaagatgtgatcagaagagaaattcaggcagcaggctacataatcttcatagaaagtaaatttcaaatgcatcatacaaaattcacagacaaacacatataattgcttaattgcttccttgtttaataaaatgtctttcctgatcaatacctcttaacaagttgaccaaaccaggtatagtttagcctcctgatcagatttagaccttgaatttaatggaggtatagataggtaggtaggtaggtaggtaggtagatagatagataacccatgaatgttgaagaattgtgtctatattaaaatttagccaaaggagaccagagtaatataataaatttgttcctatgggaaaagcactttaagcaaacatgtgccccattggtgggtggggaggtatatattggtgctattttttgtacagcattacattgtttccctggtggggaagaacaggttagctttataattttgggagagcaatttaatttaaaagatataccctcactgggataattaaatcctgatgtgtgaggttctttcaaatggaagatttgcttaaggtgttcacattttggttattctgaacatttctacttgctgtgttgcggagtcacgatactgaagggcacacatgtttttgtatctcacatatgtgacacatccttatctaaaatttcagagccaagagaaaagaaggaatcagatagtgataacccagtgaggtatctgctgcacagtctgcctctccaactttgctgaggaaactcgaaagtatggaaagccaggagcccggcacaggtcccttcccagcttctgtctcttagcctggcagagacttcagaggaggaactccctgagaatgggaagtcattctctagttgtcttgtgcttcgtgtttgtttttcattgtctttttcaaagtaatgtatgcacaacgtgggtaacactgacttttattggctcatagtgacaaaaacaatagtcccctgcctctctcctcctgaactctggccttgctccccagttgctaatatgttcaatgatttttgctatttcttaccaacaactactttaatatttctccataacatgcttaaatatttgtacttatttgggctgggtacggtggctcatgcctgtaatcccagcactttgggaggccgaggcaggcgaatcacctgaggtcgggagttcgagaccagcctgaccaacatggagaaactccgtctctactaaaaatgcaaaattagctgggcgtggtggcacatgcctgtaatcccaactactcaggagtctgaggcaggagaatggcttgaacccgggaggcagaggttgcggtgagctgagattgcgccattgcactccagcctgggcaacaagagcacaactccatctcaaaaaaaatatatacatatatatgtacatatatatatgtatataaatatatatacatatatatttatactaatttatttagatattatgcattgctttcctactgtaatagatgaagattaactcttccgtattacttttcacccaatttcaccttcccccatactcccatataattatgtttcaattttggttaaaccaatatgagatgattgcattgttgctgaacaagaggtacaatattacgttctctttttgtatacaaagactgttaatttagagacctagagctttcagatcttggaggggttcttctatctcaataactacccaacccccatgttcttttctcagagttcatggaattgaataatttggatggatattctaatttttaaaatttcttttttccatttattttaattctgcattctggggggtttcctaacctttatttttcagcctgtctattggctctaaatttggctaccattcatttaattgctaaggtctcttgtcctgtttcttcctttttttaaaaaaaaaatctcctaaatttctgaatgcaaaacattactatattttgaggctattccgaagaaacagattttgttctttttgaattctttttctctctgcattgtctctattttgtaattttaaatgtttattcatttagtctctgtctttatgaaacaacattcctcaaaggtctggtggtatctgtctgcctcagtagaataataaaagctgaatagaattttgggggctgagagtagagcttgtccactagcaggtgttactgtgattaagcagcgagtcagcttttaaactgaggactctcctatttgatggacttttctctggagccccctcattttcccagggcggaatccctccacctcttgcccagggaacatagctgggctgctgctgctctaggacacgggtcgggaggaggaggctgggaagggtgtctcgctcttccatgcaagcacttgcacactgtcccatcttcaactcagagcctcctcccattccccgctgggactggagtctctgagacctgaataccttaggttcagttcctccagagaatcaacctcccatctcgtgtgttactggaggagggtttttgcccaggtgcctgggctgagggaagggatcagaatacgccttattcagactttcaaccttcctgcatattcacttgctcacctggtttctgcccttccccgcacccgggccctcccatccccgagcccctgctccgtggttcctggcacctctcttggcctcttcttggcgttcatcctcgccaggtacttcggttcctgtttcttcagttccaccaaaccagccagtgttctcccacccatggtctgtctttgattacaggtgttgaaatgttaggtctgatctgctgttctctcttctcactcctcttcctgtggatttttaccttttttttcatttagtgttattttggtggattttcagcagtaaagaggaaataaatacatattaaatccagaagaatccagaatgtttaaatggaagtctttgatcctgtctgcttttattcagatcaaatggatcagatgacttaaatcaaaaggtaatatttatgagacacaaagaattactctctcctctcaacaaaaataaagcctccgcctctaacatcatccagtctgcctcccagacatgaacttgcgcacaaagatgtcagggagccatcaggcacggcactgcctaaaaagcccatgtggcataaagaatgagcaaagcgctacaaatacagggtccttctatacaggttattcacactgatcttcccaacagcactattagttggtaatatgtctatattgcagattaaaaaacatcagatggccagtcgcagtgtctcacacctgtaatcccagcactttggaaggccaaggcaggaagatttcttcagcccaggagttccagcccagcctgggcaacatagggagatctcgtctctaccaaaaatcagaaagttagctgggtatggtggcacatgcctttagtacccccctacttgggaggctgaggtggaggatcccttgatcccagcagggtcaaggcggcagtgagccctgatcataccactgcactccagcctggccaacagagcaagatcctgtctcaaaaataaaaataaaaataaaataaaatacatcagacatagagcggttaattggctacccaatccagaacaccaagtagcaaagacaggacttgaacccgggacctccaggtgtttctgggtgttctttgagttcctccatcctgaatcaatagtcaagcatcatgtataaatggagccacagtcctcaaggataaacactaactgcttgtaggccactgcaggccattcagtacagtgttttattgtgctgcaaagtcacctgtttccacaagtgcttccccaatgcaggctttctaaagtcatcatggaaagtaaattattttcccctaacaaactatgctaaaatgggcaggatgagcaggaagtgcttgtgtggtctacattgtatacaactatcacggaaagttcaactcatgggacacttgggttatctggaggacacatggccgtgagaggatgtggcgcttagaagctcccttcatcacttggttggccctcattcatgcatgctgaggagggggtgggaaaagttatagaagccagtagccaaacccggtatacccaaatgtttagcttagattgaagctttggtgtttctaatatgtacattcggctcacttccagaagacagagatgggggacttgaaaactagcttagcagagagttagttaatcctaaacctacctcgttctgtcaccttggcgatgaaatgactatcctaatacagtcagaagaggacttaataatcagccaggcaggtgcggggagggaatgccagaaacatgcaaaaccgccgacagcaagaagtttccattcttttgggggtgactgtgcataattaagtgcctacaattcccaaattaaaaataccagttcctttacaaccagcagtggcaggtctactcaggggcagtcaggaggctcccacaagtgcagctgtccagcactgcaccacacctttctcttttctccaaaagaaatagttttatataatagatatatccaaaaatgtagaggtcataaaaacaacagcagataaagctgtatccttgttggttttatttgtttgcttttggtgttatgtttagggtaacatgattgctgctgataagaacacattacctttgtaaacccagcactttgggaggctgaggcaggtggatcacgtgaggtcaggagtttgagaccagcctggccaacatggtgaaaccctgtctctactaaaaatacaaaaattagctgggcatggtggctcatgcctgtaatcccagctacttgggaggctgaggtgggagaatcgcttgaacccaggaggcagaggttgcagtgagccgagatcataccatcgcaccccagcctgggtgacaagagtgaaactccatctcaaaaacaaaacaaaacaaaaaaacacctgtgtagagcaagttcaccttttcatagcacatgcagaaagcacacctctgtgagtttgcaaagagaacagccctcttctgctgtgtgacatttcagaagatggaggctcagaagcttcaagtcttattttgctaccaggacagaaacagaagccaaatctttaggcttcagatttacctttttttcctaagagtgggacatcatatttaattttccaggtcaaagaccagcgcttgagttgatcatagatcttctcagagaagtcatctgaaagggaagtagtctgttttcttagtcacctgaaaagccatagaataagataaggcttagaataagaaaatattggtttctccatgagaagaaggaagagaaaaccaagttgaaccatttaagtctcagttgagttgaaatactcaagtgacaaaataatctgaaaattaaaagtatggtgtatctctaaacaattattttagcaaacatactctggttaaaaatgtattctaaagaaggttttatttaattataaatatctatattttgtttttcacctcttccaaaagggtagaataaagtaggaaaatgcacttgggttcatctcgaaactcagaggcagcgtggtgtggggcagagggctagcatgggaggtgggaggcctggtgttggcccgggaacccgcactgaccagcctgtggccagggcctcatctgagtggagggaggccttggtctagaactgagattcaccatacaagctccccagtctgcttgtggaccaggagtgtcttgggaatgggaaccaaactaatccaaagatgaagttcaactctttggttcttatgaagtgaataacccacaatgccatagacattcatttttctatacacttaagggttacaaaaggagttattaaatgtgaataacgtcttgaatatataaaattagactgcagctacagatttcccaggatccattccatattccctggaatccagcttgctccaagagcctggcacactctggagcttttgcttcacccagcaggtacggagtcaaactcgacacctggaatctgtatgttgctagtgttgagtggaactcaacacctggaatctgcattgctaacattgagtggaatttaacacctggaatctgtgtgttgctagtgttgagtggaactcaacacctgggatctgcattgctaacactgagtggaatttaacacctggaatctgtgcattgctagcattgagtcaaacttgacacctggaatctgatcattgctggtgttgagtggaactctgcacctggagtctgactagcattgagtggaacttgctagtgttgtgtggaacttgacacccagaatgcatgcattgctagtgctgtaaggaacttgacacccagaatgtatgccttgctagcattgagtggaacttaacaccagaatctgtgcatcgctagggtcgagtggaagtctacacttggaatctgcattgctagcattgagtcaaacttgacacctggaatctgatcattgctagtgttgagtggaactctatacctggagtctgactagtgttgaatggaacttgctagtgttgtatggaacttgacacccagaatttatgcgttgctagtgttgagtggaactctacacctggagtctgactagcgttgagtggaacttgctagtgttgaatggaacttgacatccagaatttatgcgttgctagtgttgagtagaactcaacacccagactctgtgtgttgctagtgttgagtcgagctggacacctggaatctgtgcgttgctcatgtttggggtttgtacttcagttattttacttgctcatggctttttgttgtaattgttttttgtttcttttttatttaaaaatcatcctttaattatctttagtatcttcagtttcattcactggcttaaccagatagtcgacaattatgtgttagacatatctgttctgaaaaatatttttagccctcaaattttttcaaaactaatttgcaagatgtatacgcactgtagttcaaatgtaaatcatcagtgtcctgattactgaggcagatgtatcaataagatcgccagatttgctagtgcaatgatgcttccttatacagcaaattatttttcctatggggatggtggggagatggatttggaggtgatttatcctgtaagagcaggtttggaaagttaattagcctctggagaaggttccaggatctctggggctgggtggagctataggggtgggaagcacctgggccactactgtgcaggtgtgtgcagtgaggatggctccctgtgcttggcccctctcactacagggcacgccttcttcctgccagctgtcctcagagacaagagtctcactcagcttcagctcaggcccgctctctactgagccttccacctggacttccaagtggaaacaccccaaagatcctcatccctttcctccactcgatgcctggtttggctaccacccataagtgtggtgttctgcctggccccgccaaacctcttccaggcacccaaggtctggcctctgctcaggttcaggtcttgggccatcgtgtattttccttctcagaataggtgcctgggttgttctgactatggtctaagagtcttccctgccctgccctgccctgccctgacctgctgtcccctccccttccctcccctcccctcccctcgcctccttctctttccctctctcccccgctccttccctccttcctccaggaattaagacattgaacattctgtctcatttccatgatttttcaaacagtgccaaaagagccagcaaatgactgtgcgattatctccaccaacctatttaaaacattgtcgttgtgtttgacttgatgtggtccttcatcttgaccatgatgtttgttttactgcttccttgatgtataatttacataccataaaatctacccttttaaagggtatgattagatggtttttagtattttcagagaattgtggaaccatcacccccagtctaattttagaatattttcatcatccaaaatagaaatccaatatccattagcagtcacttcccattcatccttcccctagccttcagcagcctctactctgctttctgtctctgtggatttgcctactctggccgtgtcatataaatggagtcatttggacttttgtgaatggcttctttcatggaggatactgttttcaagattcatctgtgttacagaatgtatctaaactccattcctttttatggccaataatattccactgtatgcacctgtcacactgttcatccatccatcagttgctggacacttcctggctggttttcactattcagctggtatgaatgaggctgctatgaactgttatgctcaagtttttatgtggatataactgttagatttataatcattctaattagccattttgtacttttttttaaagttttttttcttttattatactttaagttttagggtacatgtgcacattgtgcaggttagttacatatgtatacatgtgccatgctggtgcgctgcacccactaactcgtcatctagcattaggtatatctcccaatactatccctcccccctccccccaacccacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatgaccgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacctagtaatgggatggctgggtcaaatggtatttctagttctagatccctgaggaatcgccacactgacttccacaatggttgaactagtttacagtcccaccaacagtgtaaaagtgttcctatttctccacatcctctccatcacctgttgtttcctgactttttaatgactgccattctaactgatgtgagatggtatctcattgtggttttgatttgcatttctctgatggccagtgatgatgagcattttttcatgtgatttttggctgcataaatgtcttcttttgagaagtatctgttcatgtcctttgcctgaaactgggtattttattcctcagaaagaaagaggagactcgaacttctaaacataaattgtgtttgaaaatattggagcttacttatcctaccataaaacactcagtttaaaatgagcagttttaagatacttggttttgttccaactaatacctctcctgcctttttttggtcaatttatttttgttattaaaatttcttctgccgttggcacccccagaacaatatattcttcaatagtttaaaggagctgcttcctcactgggatgtggacccttcttccttcttttaattacagcgttattaaactcctccaggttgacactttctttcattctctattttagatttgtcaatcagaggtgctccatgaagcagctccttagtgctgggggaaatgcaaagccatggcgtgtcactgtgggtgcaaacctgcttctggagctgtgacgttcttggggagggagggctgtgaagggtcatcttggaggggccacccctgcatctcacccgtgagccatccttctcagaggatgagagagtggataagagctcaggagctgcaagggagcattgcgggagcactgtgcatcataagaggggaggatgaaaccgacaaagacgggcacctggcagggagtgctagtaaactgaggcgtggactacagaaacaatcctcccccgaagaacttttgaaaatattgtacagacccagggcaccctccctgacctacagaagccaaaaccccagtgtgggagcacagtatgtacgtttagaaaagttttcatatggccgggctcagtggctcatgctgtaatcccggcaatttgggaggctgaggcaggtggatcacctgaggtcaggagttcaagaccagcctggccaacatggcgaaaccctgtctctactaaaaatacaaaaattagccaggcatggtggctggtgcctgtaatcccagctacttgggaggctgaggcagaagaattgtttgaacccaggaggcggaggttgcagtgagctgagattgcatcactacactctagcctgagcgacagagtgagattccatcttaaaaaaataaaaaggcagaggttgcagtgaaccgagatcacaccactgcactccagcctgggtgactgtctcaaaaaacaaaacaaaacaatacaaaaattgtaagtatgtgtggggctcatgtgctgagtttggtgggggaaatctttccatgcacccccacaactgtctacaatatgaaaacaatcttcaagaaaacaccagcgaacagaccattcgtctttccctgttgccacattttatcttggtctcaggctgctgacctgtcagatgattgacaaatggaaaccgtatggtggctcagagggaccaggcgtggtgtgtgctgcattgaggagagggtgggtaggcaaatagaagttaagcaccctaacagaaatcattctaggcttcagagcttagccagtagcttagcaagtggtattttctaggaagccactcagattagtgccaaccttctgcagaaatacagagctataggtgctgggtgagttgtgagcaaagccatgttcagaatatgttaagtttctattttttaagtgagcttatttgctgaggtaatgcagtttgcctgaggcaaatgatcatttagatcagctttcatcttttaagccagatcttgagatttgaggcgctaaactctttgcgtacgcattttacagctctcttacttggttgggatccactgcttcccagtatctgcagacccttctggggactgtgacctgcagggggttaggtagctgttttcaggggggcattttgagcccgacattcacgttttataacattagctgtgtgggggctggcaagaagaatctagccttttccattaatttagtgactttgttcattttaattttttagttaattcactgactttataattttgctaaaccctacaaactgctcagcataaatgatttcctttaatccctacaaaatgtcaggctcccaggcctgcaggctcagagtgtatgcagggcgaatgctgcttgtgtcttatccaggacagactggcctgtctcgcacctgtcaggcaactttactcctgatgctgctttctgggacgccatccaatctcatttggaggttttgtcagtgagcagatctgtttctgttagattcaattgaggcagaggcagacactgaggacagatgggtggctgaagataacaccggggaaaccagcctctaagaaatagagccactgcaattaagacttccactctctctccagaggttgtggagtcaacagaaaagcagatccatgtctgaagaccatgacaccttagaagcccagacagacgagagggaaaacagcctagaagaccttgccttattatttctactctagaaagatgcacgggatcaataaagtaaatgagctgtttcatccaagctggccgcgcagatccagggccacagagacagacagacacataaacgcattgatcaccctgctagggcctactggcctaccctgcatggaaaatgtgaatggaaagaaggcaaggaaaatacactatttgtagttctgagccacagctctgattgtaggtcacctcctttcctctgtggaagggcagtcacattgtgatctttcaaaacattggctaaggcggtgatgataaccaaggctgatatgttaccagcacacagcagatctcagggctgagagtgaggcatgaatcttccaagtaagtggctccatatgggcctctttgaggtctttaaagtcaacagtctcttcatcatggaattcaacttgacccctgttccaccgacatcagaactggtgaggtgacagggatttagagcgacttgtcaaagggatgggaaatgcatttgctcaaatgataatgacattcacaatagtcaagattcgttgagctaggatgcatgctaagaactttacaagcatttctattaaaatctcaacactgctcaatgaaatatgtattatcgtctccatttttagataagagaattaatgtttagaaaggcaagttgatcaggcatatctgtgcagcaaatggtaagactcgacttgaactaaccttagacaaaaaaacaaaaaacaaagcaaagctgtggagtggcaagagcaaggctggccttagggacagcgggatgggggctcaggtgcagctgagaccctacccataccccttctgattgcgctgctggcttctccacttagggaatgagaggagacaatcagttgctattctgagtcatttcctgggtctctgagtaaaaaggagagaagcttcctctcttccagcttcagtttgaagagtctcaggcaagaacccggttggcctggtagagtcttatgcccatccttgaagcaatccctgaagctggaggatacagtcctaagggtcctaagttactgggtgccatatggtggtgggcggggtggggtccatcaccaaaatggagcacagagggagctagtatgaatcaggcaagcagttggctccacttccacatgagatggcagcaggcatcgctaagcctgattcacagcacctgggcttaagttgcagcaccgatacataccagctatgggactttagagagggcattttctctgtgtcttgatttccttcattttaaactgaggacaatcatatctaactcctgtgataattgggtgtgttaaatgaattaatgcattagaggagtatctaatacaaggtagatgcttcattaatgtaagctaatgttatttttaccattacttttactgttattataaggagctatgtatcttgtccaaggtcctgtaatagctaataagtaaaagagccaaaattattattattatttgagatggagtctcactctgtcacccaggctggagtacagtggcgagatcttggctcaccccaacctctgcctcccgggttcaagtgattttcctgcctcagcctcccaagtagctgagactataggcacgcgctatcatgcctggctaattttttagtagagatagggtttcaccatgttggccaggctggtcttgaactcgtgacctcaggtgatccacccacctcggcctcccaaagtgctgggattacaggcatgagccactgcgcttggccccaaaattcttatcagagttacagtgggagatatcacaccatgagctctccttctaaggatgcccaggccctgaattctggcacctacctcgcctgcattttgtaggttgcactgatttgcttagtggggccacagtcaacaggctctgatcaaagccacccttgccgcagctgacccagcagcctgcccagctccatccagggctgttagcccatcctaaaaaggccctctccttatagaccattgcccgaggaggtctttccaggccctacctcctgaaactcctctctggcctagtctaatatcccttatccttcctaactttcctaagtttccagtcctaacttccctctccacctgcaccttggacatgatgattgacactgtgacttgcttctcaaaatcagctcccctatcaggtctgttttgttctccgtcctgaagacagtggtcacgacctcgcccaaccctgggctggggctcagcctcctgctcattacaggggcagacgtgccctttgatgtcaggcctgaatagaggttccttatttattacaatttattatcctccgaatctgcctggggttttgatagaacctggctgccaacggcttgccctggcctttctgaaacctcaccatttccacaatgaaacaggacgcaaggactgtgcccctggtatgggaagggaaggaggagaagcttgcgtttacaagtgagatatccacagacagggaacatactacatttttttcttctagactagcctctgtggactagttcatcctccataaggttgatatttttttcccaaagcctggatttgcattgcctagagccacattcacggtaggagatgggtcttcccagtgtgactggactcacttcttagcactccctcggtgggtgagttaggctggaatgaagggaggagccacctttgggattgcggtgctgccctgggcacctcacactgccttctcttcctgctgctcgctggtgcatgcttagaaaacccagtcagcttgttttgacctaaagcaaaaaccattattctctgagtttgtaggtaagcttccacccaaaatattgttgtgagaccttggatttggtgatcttgggctagctgcctaacttctttgggcttccatttctgctctatcaggtaaaggattgggacagatgatcttttatggctataaacatccagtgtgctccaaggccactgccaaatatacgcttcaacaacgctaggagtggtttgcatgatctcctaggcttgggaactctgggagcagggattgtctgttctgtgcctggtacatgggggtcatttaatacacgtctcgacaactgcatagcccttttgctccctgagctgagaggacagaggaggatgttaacagtcactgtctcaaaaagccctgagcaaatctgctctgttctcagcacctctcagcactgcctccttcatgagtccctgctgggtgggtagggggctaattaagcttgagtttcaagaacttgtctacaaatccacttcaagggctcacatgcaaatcaggccctgctggcagccattaccatctcccacctgcagcccaggccttagaggccaggattcacaagcagaacaacacctgccctcctctgagagctgtgctgcagcccagggccacgtggacagggtgctggtgcattctccagcaacactgttgagctctctagtttgcagaagagtccaagggtcctcacaaaacctgtgacaactgaacaatcccaccattcttatatgatatatataaccaccattccatatgtataattatgattgaaaccgaatatcattcctgattgcagagtctccaagatggtaatttctgtcttagtgtattttccactggtagttttgtttgttttcctgactaacgttatgaaacagtattactctcctgttacagatgtacacactgggatgcagagaggtgatctgacacaaggacagcccatggtcaagcccctttgacttctgtctgctgttgaaaaggatgtgcctccctttcactgagcctcattgcaatacttgtatagattctgtgcccctccctcccttccttccttcttccctgcctgcctgcctgccacaggtgtttaatgaacatcaactatgtgccaggggctgtggagtattctagaaatgaaacaaggttcctgctctgagtttttatgttgacgagaaggaaagggtgaataaacaaatacattaacaagaaaatatcaaggagcgataagagccctgataattatttaagatgagactcaggaggcaaatgtgacttgagcagcctgccccgcctcctgtgtgaagaaaggcaggaaaacattccagcaagagagaatccccactgttagaatctctgcatgttgtcattagctgcatagatctgcttgttgaaacatgaaccaaaactttcaatcttggtctgcttgccctggataaagtgcatttctgagtcttggaccacagcttgggaaattagcagaggcaaatgcaattgtctcttctaaagtctttttttttctttttttttttttttgagacagggtcttgctgtgacccaggatggactgcagtggtgccatcacagctcactgcaacctccgcctcctgggggcaagtgatcctcccacttcagcctcccgagtagctgggactacaggtgcccaccatacgcttggctaaattttgtatttttttgtagaaagggggttttgccatgttggccaggctggtcttgaacttgtgagttcaagccatccaactgcctcagcctcccaaattgctgggattacaagtatgagccactgcgcctggccctctcccagtcttgagaccacagtggttggaagctttaacagaaaacattatatgtgtgtcttcctcaggaaatgtattttgttaaaaatctgtaacatgaagggaatggtaggaaagagtaggctgcttttgcatttaaaacaatgttaggagtgaatcgctttcctggtgggttatgttagaatgaatctcaaaccctcactaatatctttcagaggaattttggcaaatagcagttgtttcttggcctaattgaagtcttggttaatttatcccaataacaataacattaccagtatttgtataacaaaaatggtttctgactgtgccagcgtgggacgaatgagactcatcacaatttgttttagggatggagatttagaagaatgggtggagaacattctaaatggaatctatggacagggtttttattcttagtgaattttgaagaagtgacgtaaaggaaacagtttcgtgtaagccctggctcctccctcaggggcagctggacaagtcgagcagatcctggaagtaaaaggcagccccggatttttatttctgttttccctttcaccctaacaaggccgtgctctcctgctcatctctctccactgcctggactcctctctctctgccttctctctctgtttcctcccccttctctgtgtgcttccacctcccgctgctccctgctctccctgtctccgttccccatcccttcttgctctttgctgctgaccagctgtgcaactctgtgcatctgagggactcctctggacgtcagctgccacatctgtgttattgaaggggacagacacgggattcctattatggccaacgcagactcaccctttctgcaggctcaccaaggaacgaccactcagggagagtgggtctgacatcctgagaatcaccatgacttccccaaaccagtgggacatccggggcctttgactgtggctgggctgcctctgacgggcgggaccctgacacccaccttagctgtgacagttgctccatgcagctagttcctgggcacctgtgcagttccttccacaggaggacattctgccctttgccttctttgagacatgggtgtcttgcttaaggggaccagtttcccccacgtgcctctctaccatcctttggctatagggtattttaaacatacagatttattttccttttctatttacagtttcctttgggtgagaacggagtgagttggttatgaccgggggacctgagtcacaccactttgattaatgccagctccaccacgcactagctgcatgactttggacaaatttcttactttcttgcagttctgtttacccattggaaaactgaaataataaaaagaacaaccttacgtggttggggagaagtagatacacggattcattacagtgcatggcacattttatttttatcttggttaaaaaatgcatagcatagaatttaccatgttaactgttttcaaatgttcagttcagtagtgtgaagtagatccacacagctggaaaccagatctccagtgcacggcacatttttatgctggaaatacctctgttagaaataaatccttggaattgatacatacacaaagccgtcactcatcacaaatgatggaactagaaagccaaggcctattggtgtctaagagtcagcctgcccatgctcacagacctgcctggaaaggttttgttttgtttagaattttctttttatcaccatttcttcattactggaagcctggctctttgcagacaaatcgatatctccaaggttaaacaatttatttttgtatatttttcaggagacatcgagtccctgtaatgcaagcaagttgctcatttcctgcttctccagttctgtcttccttgtcccctcttcccctgcctctctcctctcttctcttaccctctttgttatctcatcataatttcttcacagcccaatttctttctttctttctttttttttttgttttgagatggagtctcactctgtcacccaggctggagtacagtggcatgatctcggatcactgcaacctccgcctcccaggttcaagcaattctgcctcagcctcccgagtagctgggattgcaggcccctgcaacacgcgccccccacccctgtctaatttttgtatttttatttatttttaatattatattctatggagtcatttcccaactagcatgtcttatgcttgaattattctttatacttaatactgcccatcacataaaagacgttgtcacgaacccagtgttgttggcagaattttggctcctatgatctctgtcacctggtgtcacaccaatgggtatattacagtacctggcaaaagagactttgcagatggaattaaggttggaaatcgtcttggattctctaggtgggaccagtgtcatgatatgagcccttcaaagcaacagacgaggtcaaagcaagggaaggactcagtgtgcaactggtggcttaagggaggagaaggcctgagaaggggctggaccctggcaccagcatgagctcggaagcaggttttccccccaccccacccccagagcctccaggaagaagtgcagcactgctgaaactttgatctgcaccgccccactcccaggccctggacagaaaatacagccactctatgctggacctgggacctatagaactatagtgggtgttgccttaagatgctcagcttgcagcaatttgttttggccgcaacagagcactcctacacctaccattcactggcagataagagcttagaagcaaggctatttattcttactggagactggcttttttttttttttttgaggcggagtctcggtctgtcgcccaggctggagtgcagtggcacgatctcggctcactacaacctcagcctccagggtagctgggattacaggtgtccatcaccacacctgtctaacttttgtatttttagtagagacggagtttcgtcatcttggccaggctggtctcaaactcctgacctcaagtgacccacccacctcggcctcccaaagttctgggattacaggcatgagccaccatgcccagccagaggctggcttttttttgcttcaaatgctttatgaccaaaactgtctatgtgcagggtccccagctgaagtggatacatattttgtgttcatggaataggaggaaattagttggcctttcagaaatatgggacaagatttcttcttagaaatgtgccctaagcaagtgaattgagtaaaagtgtggattctgagtccctgctccttgcagaggactatctggaaatcggttgcattctcaggaaaataattcagaagtgcagtatcctgtggaccactgcatatttcctgaatcagtatctttgtggatatgggaaggggatgtatgtatatgtttggtgagcgcccaggcagtacatacaaacatttgaaacccactgctgtgctccagtgttttttaaacagctggttgagacccattgaatcatgaaatcagtgtagccagaccatcgtttaaaaaaattagaagtgcataggaaagaaaaggtaatgttatcagaatgtcttgcaacatggtaaggacaagtgtgtttggtgaaacttttgtttcaatgtgtgtgttttcactatatgtgtctgcgtatgtgtgtgtccagagtcaccatgtaaaatgagcaggaatatttcagaagcactgctcttgtctgatcttgcaaatctcaagcctttgtcctggactctccaatgcgctgggtctctgatcaaccctgccctgaccacctgcgtggcctgccttgccttatggcgaccctcggaagagtcgagcaggcagcgcgtgcctggggctttcagggacacacttccttccattcggggacctgtgagtatgtcagtggaaatcatttttttttctttttctttttttattttttgagacagggcctcagtctgtcgcccaggttacagtgtgatcctggctcactgcagtcttcatcttctgggctcaagccatcttcccacctcagcctcccaagtagctaggattacaggcacacaccaccacacctggctaacttttgtattttttgtagagatggagtctcgtcatgttgcccaggctggtcttgaactcctgggctcaagcgattctcccaactctcccttccaaagtgctgggtttacaggcatgagtcactgcacccagccaaaataattttctattcgctggggagtaaagttgtctttgcatctcccgcacagatatacacaagaaatataggcaggtgctggctacggatgcatagaaatggatggcttcaatacaaggtttttggttgatgtggaacaatattaccgcatagataaagaagccccttcaaaattagctttaccaatgagatatggtaaaaaaaagaagtataagtgatgaaaactaaagagacatatgactgtaagtgttaagacttgaaggaaataataaaagccaaactgcatctctgattttaaaatatgggagtcataataaatcaacagaaaggataaaggtatgctgaggaaagccaaagaggagtgaccactgttggtcaccaaactgctggctatttgcagaagggcctgaggccctgacctgagacttgtgctcaagtcagcatagtttgggctcattggaatatgtgatgctaacgatgtcccccagaagagtattttgttcctttacgcactttttaaaataatcatctgtgatatgaaaatttggactggtcttgaaggaatgagtcctctccttacccaggtttctttgtgatgtcaggcaatgatggtaataagaatggtactccagtactaggagtaatacggtactttgatagcgcactaatgcacagcattggcagaaggctcatggtggatgtgaaattaaacgcttcgtataacccataggcgatgttgttgtctttgtcatggacaggggagaaacatgaggcccagagaggtaaggtgagcactccctaatagtcagcattgggtgaggcaggaacattgtggccctgagtccctgagattcagggcttttcccatgaagccaacccactggtcactgagtggtttcactcctttcaccaaccaggatacttcagaaagcacttggggtgacccaaagctgggtccagatcaggggagtcggttgtaagttgtcatgacacttcatccttacagaaggtggaagttactcatttctgttcaatgagctttgaagaacaaaaggtcactgctaatttgaagattaaacctttataccaacaacatcctccaattactatagaaaatttagcatccaccatttgctcaggaagcaaagaagtcactgttgaacaaactctgaaataaccaaggcctccaggccccacacctcttttaaagtgctttcatgctgaccatctttttttttttttccttctatcttcagcccctaaccacaaagccaaaaaccacaagaaggcagaaaagtacaataaatgggttttctctacccatccccagcaattgtttcacagttttattaagttggggattcttggaaaaaaaaatcctgaaaaaaaaaaaacaattctagtttaggatccctctttgagtgctctgcaacataggcgagagcagtaaaaacacgttccattgaacacagagcctcagacatagacatctgtctgttggaaggaagtcactgactatggctttatgctgaaatacacagatcacgtttatataggattttatcatttgaaaacatccctgctcagagatgatcctgcctcattctgcaacagccttttgcagtttacatggaaggattcagattaggagggagaagttgaagagcctttagactagaggcagcaggaggaggaacagcctcagatgggggagagaggagaagttggcatgtccaccactagcaaagatctgggtgctgcttcaagatagaacccaagggaagtggcagggtcccaaggggaatgttgagtgaggctctcactgggggaggtcccagattcctggcccccagcccctccaaagggttatgagtcccaggatggcccagaagcaacagggctgacacaccttaaggagcaatgcaggctgaagaagttcctgccactggtgactcatcatcagaattcccctttccctgggctgtggctctgcataaactcacaggactgcagaccaggcctggaggagatgaccccagagaggaggaagactgagtgtgctgccagcctattagaactcagcattgcattcaaattctagttgctctaaagaaaattaggaaatgtgatatttcttgcacacctgaatttgtaggctacatgcagaacaaaggacaaaatgagagtccaagaaggaagtgcagtgctttaagggttgagtgaatggagactgaagggtatttaacgggccattggcatcaaattagaaagtatgggtcttagaatttcttttacattagaagactttgggctgaatattgatattctagggataaattcttgataccctaaaattcagccctcatacaaagcagtgattgtgatttcatgaatgttgtccctgagaaacaagtgtctggcatgagctccccatgtctggaccaccaagctgataccaataatggctgttgcttccttttcccctacatcaaaaccttaggtttgcttcaggcttatggccttggtcatcctaggagtcaccaacttgctatgagaagctggcctgattttgtgtcactttcatctttgtaaagtataaacacaacatgtgaagttgttaattttcagtgcactgccccattctgtagcgttctactttgtaaatgacattgagcatatacactttccaccattgtagtaagcccaacattcagtgaagacagatgcctccatttatttaaaaaaaatcaacacattattaattttaatgcaatttaagctaaaaatgaccgacaattcttggtttaccaacaacctcttttaaaaattgagactctcataagaggatttcggtttaaaaatgttgaaaggtctttttgtatagaaacagaatgaagtacaggatatatttaaaatgtggctaattaacaaaatatttgtggtggctcatgcctgtgatctaagcactttgagaagctgaggcaagtggatcacctgaagccaggagttcaagaccagcctggcaaacatggtgaaacctcgtctctactaaaaacacaaaaattagccaggcatggtagtgcgcacctataatctcagctactcgggaggctgaggcataagaatcgcatgaacccgggaggtggaggctgcagtgagctgagattgcaccactgcactccagcctgggcaacaacccgggagacagatagatagatagatagattctctctctcaaaatatatatataaatatatatatatgtataaatatatatatctatatataatatataatatatatacacatttatatattatatatagatatatatttatataatgttatataaatagatatagatatataaataaatatatataaatatatagagagtatatatatgtttacgtatatatttagagagaatatatatatatattcgagtttatattattatttttaagatttcaaaagccttcccttaaacacttagatccatgaatatcccgtttttttactaatgtgggcgatgaaacttcaaatgacttgggaaaagatattctaggaatgacaatctttttttaaaaaaattcttgctaggaagaagtatcagaaacctccatgttcttacccatattttcagtgattaacagtttcttgtgatgcaagttttctccacagtttgtttccagggttacaaatccatcatgcctaccttttcaaaatcacattaattcaagttcacattatttttatcagccatcaattaaatattaatcagcttttcttggtctttagcctataggtcttacttacaagactctttaaagaggaaatactagaaaccctgccagttcaatcccctggcttggaataattttgtcagcagtactgactcctgtagctatctgtgttgcttaacttgcgacttctcttaagtggaaagttgaagagctttaagagtattaacttgctttgtttccatattgacatgatcaacaggctacccacagatctgatgcatttcaatgcccaaacacaagagcatgcccctggaaaactgctgattctgagttccagtaaagctttaagctcctgagattatgaccatttctttattttggttttccactcgtagaaactgtctttcagataagagaggaacactactgtccagagagtggtgacaaggcatcatgggagaggtgcttaaaagtctccccaaccgccccatcatacttccttgcaagagccagctctggtgtcagaaattccctagtgttctgctggtttatgtaagacatgaccctctccaatgtgaatgcctctgtagagagagccaactgatgacggccttaaataaagatcctgaaactcctgtcctcttcattcagccagagaggagctgagctcacagccctaaactattcatttctaccaatggcagaaagtgtatagcccatttttatatgtttaatatgtaaggcagcataatattagtttatacacactcatttggaccccttatctctctgtgtgtgtttaatttgtttcttttgccattttaaaaacacttgaggtgtggtgcactcatgaaaatgcatctccctctttttttttttttttttttgagacaaagtctctgtcacccaggctggagtggttcagtggtgcaatcttggctcactgaaacctccgcctccctgttcaagtgattctcctgcctcagcctcatgagtagctgggattacaagcatgtgccaccacacccagctaatttttttatttttagtagagacggggtttggtttcaccatgttgatcaggctggtctcgaactcctgacctcatgatctgcctgctttggcatcccaaagtgctgagattacaggtgtgtgccaccgtgcctggccgaaaatgcatctcttaatggtcttgaggactgagccccatggctggcagtctgggctgtggatgtgtgatcctgcttgggtttaggaggatgaacaagctgaacttctcacttaggaaattgcaaaataccattgcacactgaaacctgtaaatttattttggaataattatggattgctaagggggacagaaattaaggccataactctacaaattgtaaccaccaggattgcctaggtaacagctccaagatctccagggctccaagaagaagcgtttatttctcagtcttgccacatgcccattgctgacctaccagggggctctgctgtccccctcctcatgctggttgccatgccagaggaaagagagctctggaaggttttatgtcggggctgttcaagctgctcatgccaaagggatgctgcttccttctagaacctgttgacaggtcacccagttccttctggccatagcaaccaggaaggataatgtaacatgtgcccgggggaggtgggctggaaatgtttggcagccagcactgctcacacacagatgtcaagagatgattttcactggacagaaaagccagcagcctttccggaggtgaagtatcctccgtcttcatgactaggaagaggctttgtgctgtgtctctcggtgtgctattaatatgtgagccagtgcattgccctaaccatcaactccatcctgcttcctcatcaagagaaaaatgcaaaaccacctgctgtgggatggagaagaccagcgcattcccgaggaggcactgctttcccttgccctcacagcctggcctttgaatattctcccagaaataggttcttggttctcattctcctttcctgagccctcctttctcacttctcttcccactctgtgccctggagtgccttcctgtaattcagagctggtgttcttttgggggatttctcttcatgattgagatgagactgtctaaggggctaatgtcacccatttcagaattcacttcccggataaggattcttcatagctgtgttaagattttgctgttgttgagtccccagctggctagtgctcttggcctccatcacttttctcttcctcctttcttgccccctttggtttcatgaagctgattttttctcaagtttcgactcttgcctctgagccaccttttcagtgcatgactttcactgccctaaaataacctatagcaagaaaatcccaaaagaacagtgttcattcactgcttctaagtgacaatcagaacttcttttaaagacagcatattattataattcattacaatgaaaaacagaaggtgcctgggtgagttgaagtaattgtttagttgtggctcctgatctttttaaaaggtctgcatgtgaactaaacactctaaatatgtccagtccctcctgtcaaattcctgtaagggcagaatcacctcggggagtggttcttccggagtggtgattgacatgcaaaatgctgcgcagagagcctcagcattcactagggcgtcttccttcctcccctcctcctttccttcctccatgactgaaggcttgcgtggttcccacaccctgctgggcactgatcaggttctaagatctgccttcaaggaacccacagcctcatggagagaacgacggacaattaggtcaccacaacaccggatagaaaccccacaggcgcagtcagtgcctgcctggctcacactttcataccctagagccaggactccaaaaccatgtgtccaatgaatcactcagcaccgggactgtcacaaaagtgagtgtaaagaactgtgggtcattccctctgcatcgtgcatttctctgacaggggccctgcactatttgcggaggcatctgtagatttatttcttaattgcctaaaccactctgaaatacctgtccattcccttagcataagattaagtggataatggccaaatctctatttttctgagtagccaaacttagcggtcagcatttagcctttatccacaaacatggataggaagccctgcccctgggcatggcagacgggcaggaccaaccaagaagcagggaccagcccaggcacagtgaggaccctcagcatcaggcaatgattttgagttgagataatggttagtgtctgtgtttctcagagcaggatatgctctttaatctaggatgcaaagcccatatgaggtaagaaaaagaatgtagaaccatttggaaaacacccatttttcccctgggaggctgagtaggtcagggggatccgctggcagggggtcctctccactcccctctgattcccagaggccgagaatgtcgtgttcagccattggttactctgtgctgcacggtgaagtctgtggttgttggtaagcagcgtaaaagccagggagtgtctgctgcaagaatccctgggcatcacgttgcttccgacactggtctgtgtgagtcccacagacgtcctagcagctgcaaggggcacacacctccgacctccgaccggcaggtatgaatgcttccaaagtgcccggagtgaacagattaaagcaattttggagggtgagtaaaaggatacaaatcaacttactgaacaaaaagaaaaagtttaatttctggaaaaaaaaaaaaaagtagctgacctgcagtctgagatatgctgagagatacacacattatcttacaaaatttctgcggggaggttcagtcgtgcctgtttgatgccttactaaatgttgggaatctaattttaactgatctgcagcagaagcaatcagcagccagctctgtgttgggtgtttactcagagcaaaagttttctgggaaaggcagtttagcatctgagccacggtgcgatggttagccatatttatgaccactcatgcatcaaccagcatagtctgatcttagcctctgggagccgatttaagtcttgaatgtgatggctaatagatagaattctgaaaatatgtgtatatatgttttccttcagactctctagtctctcagaagccctatctaactagaaggacaaaagaaaatctcagtctttgcattgtactgttaaagcattagaatgtactaaggcaattgtaatcacaaagcattcaaatgtatggtatgcattgtaggctattaacataatcctgtgtaatgagaagatcagcaccaagctagcctaatggcagacagcttctgggatttcaatttttgcctggattcacagaatagtaaaacctcttgggaattcattgcttttttttcagttgtcagaagctaggctctgtgcaacaagtaaagaattctttcctgaatagttattctacttgggattcagggagatggtaaatgtccacgctgggtatcaatatcagagtccgttccatcagtgcttagggtctagaaaggaatggatgatcctgaagccgatgttcagtgatccctcacacttgtaatgcagggctggaataacgtgatgggtaggtttccatcttggttgaacattttatgattctatggttttctttcaatgctaggattgtcatcctgatcgttagaaatcactttagtagatgaataaacagcaagcagtgagcgcatctaatagatttctgacaatagatcgacagcttttctttctctctgttgctctaagtcatttgagaaaagcctggggttacagatattctttgtcaattacttctggaatccccatatctactcttttaggcttttaaagatgagataatatgagtatgctagtaattttgaaattacttcttaagcaaggttctgcattcactgggtagaaccaaaataatgcctttccaaattaaagcatgtgtatagtatataagcgggtatttcttctgagtaagcaagaagatattaaaaacattgaaatgatggaactctgcagaagaaccatatgacgcatgcacaactctaggctgcattgggaaaaccagccatatttgggtttgggattagcctcttggttttgtgcaagttgcttagtgccctgtattacccatcagtgaagtgagtggttcctcccagctctgagatttcatccgaacagcatggaaaacagtagatcattttcaccaaatatctgtgtagataggactgggaacatctgattaaatgtgttgagtgtcacattttctagatgttagaggactctgacaatgtcttgttgaaatcatacttgggtctggctctggactctaaaaagctcttccttaatgacatcagttgtgatggatcagagtcacttgtagatatggtgatgaacaaaagactagtttttattttctctttcacagatgaaaccttattttagccactgacatctccgaatgatctgaaaatgtattgcatacaacacctcaaagtttcagatggacactccctcagttgtatttggaagggaggccccaggggccccttggcatcctctgagagatgttcctgcagacgcacaatgcacacaagtgcacagaggcaactgacttggggtcccaagctagtagcacacaggcatggcctgagtactcagaggaggactccggtggatatgagcagacacccagggtttcacttgtcaccaacacagtccagatgatgaagcaaatactcaatactccaaagaattccttaattatttaggaaatttaaatgggtgatataattactcggttgtctcaattctgaattattcattctgtttttaatggtagtttgatgctagtaactccaggctattattaataattttttaaaaaatcagaagtagattagaaaacagtttcagaggaaggatttaaaagcctcttaatggaggagtggctatgcggcattgcattcaaacagccacagctgaaggctgactgggcttcctccaggctgtcctccttcctgagccagttcccgtttggagtctgggctggagggagctcctggcagtgccatgactcagtctggtgaaaaagcctgtgtgtgttcaggctgactttgaaggaagcacctctaatgatctgcagccagggtggctttgaagatggtaagcatagaatttcaagaactggactttgggtactcgtatgaaatggaacattattataccactaatttgttctctttaaaaaacagtgagagtcttctcatggttttggtagtctctatttatttatatatttttattggtagcaagtgggaataagagcacagttgtttaaacaaacccaagaccattctacttgctgtggctggaaagtgaagagtattggaatcactgttttaagtggctttgctgtttagactgaatgtgcacgagagccaaatgactatttgatttcactagaaaaatctgtaaatctggttattggatactgtataaagccatttaattccacaaatgttagcccacagaaatctgtgcactggaagagctcctttaaatttacaacagcaagaaaaataggtttgctttcctatatactctctactgttagttacaatgacatgaaacaacccaagtttgaatatttaagagtagccacaatcacgaagggcagtgtgatagaaccgagcaatgaacaggatgtaagaaatcctggtttaatcctatctttcctatggttttgcccaaagtggtcacttctcctccctaagcttcagtttttctcacctgtaaaattggggaagagggtgtagatgaaatcagcatgattctgcatgtcagtagtacattattatctcctagaaagctttaaaaaaaaaacttctgatgccgagactctaacccactctaattaagtcagagacacaatggatgaggcccgggatatcaatacatgctcaataaagctcaccaggtcattctaatgggcatctatctaaagttgagaacagtagaaccgtctgaaggtctcttctggctccaacattccgtacctgaagatgctaatggctctttctcaatgtcagagcacgatgcagatcgtcttgtggtcacggtggttctcttgactcttctggtcacgcgtaaagaccgggagtggaaggcagcacctcagcagatccaaaggccatgaacaccccacagtgacttcccaagctagagactgtgagtgtacttggtgtggacaaggcattcgggaaccactgaattaaatgggatatttttattcttaagagcagtgaactctactttcaaggggatgaaacaagtgaaaaaaatactttcccccccaaatatatttgtcttggctacaccgaggtctaatcagattttaggtatacaaagattaataagacacagtccttatcttaataagacatagtccttatcttaaattaatttacaatctagtaggggtgagggacaaattacaatctagtgggggtgagagacaaatagtaactgtgtaatgtgggggtctctaagtctgatattgcttagctatgcagttttctagtctcagaaacttggctaatgaattcaaaactggaaggaggacccctaaccctgtcatttgcccagttaaggtagttgagttttgcgagtgagcttttcattatgctttccatacatatttctttgaaacacaaaggtatctaataaacccacacaaccccacacctgtacacacacagactctggtattgcgaagtgtttacactgatgtgcaacaagcctctatgtacttaaatatgcaaacctatatttacatatttcgataaaagaacaaaatacaataggatacttcatcagtcatgacacaaaggtgaaaaccactgttaactacttgtgaacctcttattctatccttaagcatctggaggcagcttgtgtattagaattattgagcctccgtgtcccagatttgtgtcagaacctatccttatccaagacttcttccgaccagggagagaaacaatagcctgggtgtttgtgttctttgcagctctgaccaggtaagactagttgtctataggtctccttcttgcgttctgtgggtctccctgaaaccattttctgcaggttgttaggaagtagggaaggctattttaaaattgctaatccaaagaggaggtaagatgagatcgtgatacctttttccccaagggactaaccacacaaccaaccaaccaggatagtttagtagaagaagcatcaacagtgctacaaatcagaatttgaatttgtatctttccacaacctagctatgtttgcttaggcaaatttcaacctgcctgaatcagatttcctccaatttaagatgaagctggtaatacccctacgtagtgtttgggggtgaagattaaatttaatattaatactgtttatacagcagctattaaaataactagcacatagtagatgttcagttagtggtgtccaaggtggctgataactgtcatgggagactgagtgcaccacttagtaagatgtttgttccgccaactcagtctctatgaagtagctctgtgtgatgtgggagaggtcatggggttgcagtggtacatttggaaaaagaaaaaatactacctcttagactcttaatggagtaaatggtgtcattgcgtagattctcattagccagttctcccttccctctcatgccgtgtctctggggttgagaccagcgaggctatctttgtatttgaatctctctttgtggtctggcttgtgtttcagtgtatatctttccacacaaaccagatcaactgctttcagctctgggaggaaaacaaagaaacaaaatgtgatgcagtcaaacaatttaatttctcaaagctttatgattcaaataaccaacaacattttacaatgagtcattttgatggccagtaacaccacccatggcttcttctttggccttaaataccgtccttttagagaacgttcttagtttctttttaaccaacagtcaaaaattattaatttggctctttattcatgaacattaaaagctggaagttaataaatattttatgattgtaaagctccaatgcatatctgattgatatggagggataaagaattgaaggcaagagaggcctcctctttccagaatttgcaaaatcaatataacttgggctttcactgatatactaggtgcatgactaacattggctagagcaggtgctgtctgatggaatggcgctgccaggaaaccctgatgctgccccggggaggtctccaggtgagtttgatcattgcatctttccctagtcttccaggtgaggttggctagaatacccaggggaggaaaagagagcgtttatataacaccaccagcccctctagtaatgtcaagatttgagagaagtatctagtagctcttccttctcaaaaggtgatgggttcctgggctgcaatgtatttttgaaaaatcatatctcaatcttggaataataagcaggcaagtctgtcagttaaaaggtacttaagtatatgatttaattcatattatgtaatttttttctgcaaatatgttcaggaactcagctgcagtgttggtttttctttaaagatttttttccctttcccctagtgaaccagaacagattcttggagcttgctattgattacgcagatggatgggtctttctgagctaggaggagagaactaggataaatagagtccattttttttccaaaagcctgaaaagcccatgaattcacctggtattctggcaagagctgttacttcttaaagcaaaaagggcattgaataggtttttcataggatggcccttcaaataactactcctagccaacaaaatattttagaagcttgctttgccatgtgctcttgtaggaacctagaaaatttccattatcagctgttttcaaagaaaatatttattttctttttattttataaaaggaaaagttaattcatgaaatataaataaattctcagattggctattatttgcttaatagccaataataaaagagcaactgctattgattgcagagaaagtcagtgaacaactttgtgaatcaggggtctgttgatagcttattgttaggggagtaatttgcgaggttgagatcctatgctctgactgctgatgccattttctgcaaacgttgcctgagccaagtcactgactggcagggcttgtgtatgtgaaatacaaacatacttgtaagatttataaacgattacatggtcacgggcatcttaatggaaagaagactgctaatcattgacattgaatatgtagagaacacttcttttgtaggcagatagacttattaaggtatcttgagtagttctttaatcaccctgtctctgttgccttatttataaaatagtgataagattacttaacctgttaaaattttgtgagaaataaatgagatcataagtgcaatgtgcgcacacaaggcctgtcacttctgaaaaaaatgttggtttcccttttccctctgtgcagaccagcctgcatttaccctttagctgaagcatctaggccaaggatgtgtgtgctcagtgcatagctattgaatgaggaatgggtagaagattgattgaatgaatgaatgaagctagcttatgttcaataaatacctacattagcatttatgggtgaaccctgaatcagttaggaatgcgtcgagtctgtttctaaccaggctgcctcattactgatattaacatttatattccctgaaagcatcagggaatcaggaaaagattctttcccatgttgtttctgttcttacctggccttctttagggacatgaacttcaggtagttctggctattagccactgtacatagacattacatatgcattgtttgttattctcctttgaatttaagattgctctttgactaagaaagtagagtgtttccactctataatttatcgactaagaaaaagaggcaggagaaaaaaaaccacacacaagacaaacatttaacctaaggctttcaggggacaagtgctggtggatttctgtctcttaatgcttgagtattttcctgttttagctgcacgagtgatgaaagtgaggtgaagactgatttaaaggcaccttttagttcaagatgccttgtcttggcaaagattttaagatgaaacaaggtctccgactgagcaggcagttatcattaaatttcgttttcccattgaatttccattttttcccaattgtacaacgtcttgatagcatcactgattcctcatgaaaatacatattttctacttgataaagccacctacaaataacttctcccatcctccaaatcccacaaatgtgatccctactacaattagctaacacctagtcactagttaatctggtagaccttccagttccttcactgcctcttggttccaggtattgcaccagcactgcagaggcaattagggcagaggccttaataagaaggcctccactgaacttaaagccaggcatagggaattcgtgaaagaaaccatagtaaggtgtgagaattgccagattaagacagggataaagtactcttgaaatatccaaacagaacacttacttttgcccagaaggcagaagcttgaggaaggccacaagaaggagatatttcaattagatgcttttataaatgaattttaaaaatccccatatgggtcaaatgaattctaagtgaagaaaacagtgtggtctgtggaatagaaatacggaattttatagaatctcgtgcaaacaggaattattttactccagctagtaaagcaggtgtttgaagcaggtggcggggagttggcatgagggtggccgtcagtgaggccagagaagaccccaggccaggtggaacatgtccctgttgtacggaagtccagagctagtgagctgatgctcatgcatcatttgaaatagtaaacatggaaattaaggcatgtgctgttcagaaggctcagtaaataacatgtggagttaatgcttcctgtatacatgtagacttaggtaagcaaagcctgaggttcttgggccttttcacttgctattgccatggaagagccaacaaactatctctctcagttccagcagtcctggttcatggctatttacatgcaaatgtcaacaccagattgaaaacatcagagtgattttgctataaataaaaagtacattagacttttagattttctttgggatctgttagtgagcattacctgtgcgtgcagacctgtacaagacatcttggaagtgataggaaaaaacagcattctcgtgtgtagtagatagattcctattttcacacccttctctagatatctgtcagatgatcttatactcatatttttgaggaagcaagagtgggatatctgttagagccccatttgggcaaagagtaaatagaggggcacagtttttatggaagcctggaatgatggattacattttaataaggagagaaatttggttgcagggatacgaataagcaggttgaatggaggggcagactgggaggctgagtctcaggaccgcagggccagagcagcacctgcaggtgagaggtctgcagagaatggcagcatgtttggagtgcatgtgaggcaggggcatgggggcttagagtgctcctcttctcatggtgggctcacatatgtgatgtctacttgtgtttggaagcctgggtgacaggtagaccacctgtgaaggatggggaaagagattcctcactttagtagcattatcaagttcaagcaccagtatggaaataggaagaaagcaaaagtatgtactcctcccggctaagcaggttgtgagaatcccagcatccttgcacaccctgggatgcgctcaccacagaggggtgtgcgctggtctcaagggaaaaacagaagcaggcctttttgaattgaagtgcaattggtgtaatataggcaaaatagcaactcttttcctaaaggaacatatcgtgcccaattttaattagctctgatgaagtctaggaaaatgggtgactcgtcagagaagctgttaaacttcagagaaaaactgcctatagccccaaggtattccttactttgacaaaattcttatttttccttaagtgtttgtcactgtgaaacccgtcccatttccaggtgccgtcactgttggtatagcttgaaaaagcaacacacttcctatggtaagggcagcttatgggtgtttgcaggtgcaaggcaaagagacacaaaaatctagatgtcagaaagaaaatataaccagggggtgaaatagaagggaattatcataaaaatcaagatgaattggtaatgaatcagatgcatatttttttctctttttgaacagttttattgagatattaatggcatacaacaaattgcacatattttaaagtgcacacattaataagctttggtgtatgtatacatccagaaactcacccctcaatcaagatgctgaatgtgtgtgtctctcctgagagtttcctccacgccctctgtgacacctcacctcgctcctcccaggcagccagagatgccctttctgccatggaatgtttgtgtgcatttcctagaacgatacataaatggaaccatataggatgaattctttcgttgtcagacttccttctttatcccttccaataggcgtatagcaatatctcattgtggtttcgttcgcacttgcctagtgagaaatgttgttgaaaagtttttcgtggacttattcgtctctcctctgtcttctttggtaaaatacctggtcaaatccattgtcagttgtataattggattttgtcttgttttattttgttaccatttaattttgagagtttcaagaaatatattctggatacaattcctttgacaaatatatcgttggcaaatattttctctcactctagctcttcttttctttcattctcttaacagtatcattagaaaataaaattcctcattttgatgacgtccagtttgccagttggttctcttatagattatgcttttggtgactgcctaggaaatctctgcctagtagagagggtcacaaggttctcttctatcttttttttctagaagttttaacatttaggtctgtggttcattttgagataattgtatattgtatgaagtacgggttgaagttcattttttctgcatatggctatctagtcattccaataccatttctcgaaaagacgatccttcctccttgaaatatggcagtaacaaattatagcacatgtgatataaatgacttgcaaagccacacttccaacctgcattaggaatggacggttacaagggccgctccaggagcccacctggaggaaaatggaaactgccattggctggcagcctgttgggtaagaatggaaactgccgttggctggcagcctgttgggtaagaatggaaactgccattggccggcagcctgttgggtaagaatggaaactgccattggccggcagcctgttgggtaaaccgcatcaggctgcattcacggatgctcttctgtggcactgatgggatgactccaggaagtctatggggaagtaccacaaaatgtggaggaagatggcactagacacctgaggagggaccacatgacctccatccaggtgccaaataattacagttgagatgatttccctgcctctactaacccaaattcacccaaattcattgtccacgttggtgttaggtgatatttccaaaaaattctgttatgccactcctttgaaaatttcctaggaacctcaggtaggtccttcttcttcagagttctagaggacagcagtgtgtccttgcactccctgccatcttccagcaggaccctgtgctcagccctgctttccacctgtgcctcgttcttacatgccttgtgtgagggatgtggcttttccctttttcggtttggcaaacaccttctcccttttcaagaccctctctgaaaacacctcatgtactcctgttggtattagcccctcttactttgtgccaccagatcagtttctgtctctaaatatcattttcgctccatcggatagaataactgttcctcctctcctctctgttctgtgtttccccacagagctgtgatggatggaggcctgtttgctgttagatctgctacagctggaatgtaatcttgcttggagtaagaacttacaaatgggccgggcacggtggctcatgcctgtaatcccagcactttgggaggcagaggcgagtggatcacttgaggtcaggagttggagaccagcctggccaacatggtgaaaccctgtctctactaaaaatacaaaaattagctgggcacgttggttcacacctgtaatccaagctattcaggaggctgcagcagaagaatcccttgaacccaggaggtggaggttgcagtgagctgagattgtgccgctgcactccagcctgggtgacagagcaagactctgtctcaaaaaacaaaacaaaactcacaaatgttcatttagtgaatgagtaaatgaattcagtgaatttctgtgttattcatactcatcctactttcatggagtttttatgaaaaggatgatgaccttcagccatggggagcattgcactgcctccttccaaggaccacctgggctccctggccatgagccagttgccccaaaggcatttgacttagattaacctgaaaacatcgatgtcatcatccctcagccctgctcagaaagctgcagggagccttcaccctttcaggaccgaggccaagctccccaggctggctttatacatcctctaacagaagctggccctatcccgtttccacttaattgactcttccccatgggatactctccttaattaaaattcatctctaccccctaataagcgtatgtgttcctacctccatgactttgcaccctgaaatgctctcagattccagtaaaatctcccttctcctctttaatctccaagtttctatgttttggggctctgagtctcttctccccataaagtctccctttctgaatttccagcctcactgcccactgaacatctaaccagatactgctttgtgtattgagtttgatggtataattagatggtgtatatttctgccacccacggcacagcctggtgaattgcaatctttattcattgatattgtgatagcagtgaacttgggtgtggggaaagtttaatgaaggtcaagcagaagatatgtaaagctctaaatacagagagtgatgatttattcagagaaataagagaatccatggggaataccagactctagcttccttgtggacaagaagcattcctgtgcctctgtgtgctctgtgctccttctccctaactagatccccacccttgccctagcttggtgcactgataccatacgtcgatgcagacactaaagagatgacttccacctcctcacaaatattcaggtagaagaccttccctcggaacacccggtcatcagagagtgttcctgatttcgcttttgcaaacaagaggtagtccagcttggaagaacatccagcgccttccctgaaattcatctgttctccactttccactcttgactgtcataacaaaggacagttgtaggtggtgcccagtgacccaactcagtcagctttatctattggcaataaggtagtattgacatatcaatatttccttgccaagatgctcatttgttcttaataagaatcaataatgttcaattaatatagattatgtcactaagtagttaatttagaatgtcgttgctttgcagttcatatcctaacccacctgatcctaacagcatccacctaggagcccagaccgttgggaaggagaagagcagaaaacctaactggtccacctggaagacctagaatttcattccagcaggagcggcccacccaggaaagggcctccctcccacagcagctgctgggaatcactctctttgatgacatcattgtcatctgggcagggagcagaaccattttggggtttcccatccattcagtgctcccactgaggtcttggagtatggcccagatggctgtagatgtgcaaacttacgatcatcctggagcacggggccctgtgtcatatggatcctgcttgatgtgtagatagtgcattattttcctacttgagctctttccttttccaggtacatagacagggttgccttgaggcttagtcacccttcgcccattctgtcttactactacagagggtgagagactggacaaaggggccctcagtgtaattttcacttcacatattttattattattttttttttgagatagggtctcactctgtcgcccaggctggagtgcagtggcgtgatctctactcactgcaacctccacctcctgggttcaagtgattctcgtgcctcagcctcccaagtagctggaattgcaggtgtgtgccaccacacctggctcatttttttgtattcttagtagagatggagtttcaccatgttggccaggctggtcttgaactcctgacttcaaatgatctgcccgcctcggccacccaaagtgctgggattacaggcgtgagccactgcacccggcctcacttcacatattttaaatttattccagtagtctaagcattatgcaactctggttagataatgaaggtcatgatacacctagaaggttacagatttcaactggattaaccattgttatacaaacatatgtgcatgtggatatcagaggattcagagcctctctcctctgttttgtaaattgaccttcagtctctcatcttaggaatgactcttggccttggatgagggcctgacgagggtgggttgagttggtaaaacccggctgtgttagtttccagtccatctgaacccacagccccttttcctggctttccctgctatagcccatgaacacaatcacagtttctgttgatcatcgttatggtcctcccaaatccttcacctgggctattggtttactagggttttttttttttggtggatttgcccaaatgtggggacacctggcaggagacagcagctggggttcctcgaggctgcttggagccctggcccctgagtcaagtcctcacgttcccttttatttccttctcccctaattgcaagtcgtcaggagtttcaaatgcccaccaacatttggagaaggcttgtgggctgtttgcaggctattcagccccaaaggctgtacggagataggtgtgggttatcctaagcgtccctgctcctcatgttgtcactcatccattttcagtaggcgctgctcctaaaatgcacgttaatattgatgctgtttcatccgggttcttttcctttctacattgcctcacctggtttccactattccctagtaactaggtaggagtcatttttttagatgaataattgatttgcttaagggactttgggcaaacttaattggtagctgagttagaagtacacattttgttcatttatttgcccgtcctttagatattcatgaagaatttgcatagaagcctagcactgagtttataataaaaattaacctcatggcatctatactctcagccacttttttttttttctttttttttgagatggagtcttgctcagtcaccaaggctagagtgcagtggtgtgatcctggctcactgcaaggtccgcctcctgggttcaagtgattctcctgcctcagccttctgagtagctgagattacaggcacacaccaccatgcccagcttttttgtgcttttagtagagacaggttttcgccatgttggtcaggctagtgtctaactcctgacctcaagtgatccgcctgcctcagcctcccaaagtgctgggattacaggcgtgagccaccatgccctgctttctcagctactttaaaacaaataacaacaaaaaaatctcctgattgtcagtgcagagccccgcccgtaatgcctggactcacaggctgctgggcttagcagtctcctcaaccccagctgcacaatggaattactcggagcttttaagaaagaaagaaataataataccaattcaaaatcaaacacggaacacatacatcggtcatcagtcacataccatagattcttatttaatcagtccagggtgtagcttggctttggaaggctttttctttcctggctcctttttttttaaacaattttttattgatgcataatcaatgcatatagttttggggtacatgtgataattaagtacattcatataatttgtaaagagcaaatcagagtacttaggatcttcattaccttaaatatttgtctttatgctaggaacattcaaatgattcccttctcgctattttgaaatgcacagtagatgagtgtatgctgcagccaccctgctgatctatcgaacgctagtgtgcagctgagggtgagaaccgccgggtggagattggaggagacctgagtctttaataaacactgagccgctggggaaaaggtttgaggggcatttgctaacacaaatgctaaaggtcagtactaaaaactactcaggccattcttaggcatttttgtcttagaaaatgtcaaaacagctgtgacctcatgatttctgtctcgtgaggactctgaagaatgccttagtgctcctgaattaggttgtaaatattgtacttttttctcttgagttttctttggaagaatagtgaatgattaaaagaaaaccaaagcagtactattattttagaatacggaaatgcaaggtagcaaagtgtctaacacctagaaagttagccccgcctggacaccagctgtgaagctctgtattaattgaacaaatgctgtccaagaaagcaaaacttcctaatctcttctgatggtcctcaatataagattagtatagaatcttcttagaattggtttcctttaaaaaaaaaaattgtgggcttctcttccccatcaaaatgacatccctttgagattaatgcaggaagcagagggcacggtggaacttgtctcgctgaatattctgacgtggtcaagtttcctaatcaacagcagagatacaaacttgcattatagttgtgggtggtggggaaaggattgcctttttttgttgttgtttttttttgagatggagtttccctcctgtcccccaggctggaatgcagtggtgcgatctcggctaactgcaacctccgcctcctggattcaagaaattttcctgcctcagcctgccgagtagctgggattacaggcacctgccaccatgcccagctaattttttgtatttgtagtagagacagggtttcaccatgttggccaagctagtcttgaactcctgacctcaggtgatccacccaccttggcctcccaaagtgctgggattacagatgtgagccaccacgcctgaccaggattgtcctgtaaaagtgaatttttctaggcaattgaagattgttaaaagtgggttaaggcttatgcctacctaaaacattcattccaattagggcctcatccacatttaaattccagattctgaaaacccttcactcctaaataagaaagtattggggcagcaggtcccacgccggactgtggaggttggctacgtgcagtgaatgagtcatttctgtaccctctagtgtatgtgtaaggtacagctgcagatagatccataggaaacagggactccaagaatagcagttagtaaatccgtgatccgtgtgtcatggttctattgaaaggaaagtgtaaccacatcagtgggtctgcataccattgaaaagagtttctcaatcaaaaacctaaacacatgtcctgaaaccatcacttaagcactctgagatcttgatccaattacctaaacttcctagatctgttttttaattttttttgttaaatcattgcaataattcttgtatcacagagttactccagagattaaataaggcagcgcatctcaaacacttaccagtttttgttaaattaggacctttttcacccactacagttagtagtacctaaaagtggagctacgactagttttcttggagtgagttttgggaatttaaataagtaaatcgtgtgatggagtttggaagtgataaagcactatataaaatgctcatgcatttccccatttcccaaatgtccatggcatgagtcgtgcattccagatgcctggtgtgttctgggaatgcaaggctggccatgcgctgggtctctcctcatagggtttacagtcagttaacagcaatgcacacaaaaggatgtattgaaatagatccattggaggagtaaaaatacggtgacaataaggggacagagaagaaaacagacaaccatggccagctcctaccggaacagtggtaaggatgccgaacacattcatacatttctgtgaaaatgcaagcccttccatttcattttggttagtaataatcatatattttggccaggcttccctcccccaatttcctacggctctgcacttgacattcaccaaaaccctgttagtttcccccaaaccggacgtgattccactcctccatccttctgcccctttccgagcagcttccttcagggctcacccacacctggaattcagcaccagctattacatctgcatgtcggctcctgtgaacccgtcatcccctcctactacaggccggggccactgggccctgttagttcagggcccctccattccccagaatcttcttccactcacaacagggcaagggtttttaacatgcctccttccttccatgccttgagcttcttgcaggcaaataacaaaggcattttgtctgagtccccagagctaagcacagaacctggactatattaggcctttaatttttttccaaatgtcagctaacaggcacaggcatgcatacatacacacgaagcattttatttttttacctgatggggacacaggccagggtttgacttaggagtacataataaggattgacaatcaggacattaaagcagataactttgggttcaagttctgattttgccgcttactaggtggtgaccttgaataaattacttaaattaagattttcccactcacttgaaaatggggataataaaaatcataacaatacattttggagagtattaaatacggaaatgagctaaagttagctcatgcccggcatataatgtttgcagctagcatttagagtgcatggggctgctgatgtgttgatgcctgaagttgcgcaaatacaggtgggtagtggaatacggaaacaatgatcccataaaccaggcccaaagccccatcactgaaggaatgcttaccttagcctgaattttccagtatcctctacatgccacaggcagagccaccacccagagttgaagccatctgaaggtgacatgctgcagccttgtcctcgcaggtcattcttcagcctcctgacctctgctcagaagcctgtctgtgcttacggactgggctctgcacagctgtcacatcctatcactgcccctccaggtttgcagtcaaagaccacagcagagatgaggcataatgaaggacagacacacccaactgagcaccaagcaagcgacatatcctaatacatatgtgcgatgtgtgcatgtaagggcaggagagcaggagagaattggaggaaatagctgcaaccaaaagtgaagaaataataagacacctggaaagaggcctctctcttctgatctgtgaggccgtagtgcagtggaagcgcctgatctagagagaggcaggcggatatttgtccaaactgcagctcacacctgtaaccccgtttccctcctcaagtcgtctacatttactttgcctcagtttcttataagaagatagaggcagtaacatctatttttgtgtgtttttgtgaaaatgacatattatagagaaagagtctgttaaaaatagaagtgcttaataaatagttgctattgtaagtggatgtcagaggagctgttacaatatatcccagaaagtgagccctgggaaggcgccgattttccatagcaatcctgtttctgctttacagttgcttcctcttacgtgcatttacctgcctggtcatcctgcagggcagtgccacctgcgcagtggtgtgttgcatccaggaacaatgtccacatgatcagtgtcaggcacagagtggcatgggcatcctcaccattctgtctccagtcccatccgtggacaaaatgccccctggaaagttgaacagagattgcttcaaatgggccaaatatgcattagtgaggaactaaactgctttgacagctcctgtgtctcctggatgggaagtggggagggagtcatggagttttaatctcatcctctttgtggcactgggcacgccactcaagatccctgcttatttccagcttatagcatagaatgagaagccattcacccttgtgtagagtgatgctgggaagaattaattattcaatgacttaagggtgcttctgatatcaaaagagcccattatcatcatcggcctcctctccccagtgtgaacacacggcaaacctgagactcattggaagggacgctgctcagacctgcgagccccatttccatgggtaggtgaaatgtctcatggctgccgacacccttgcggcaggtcctgggcgtggttaagtagggggaaagtgtatttcttttctgtggcaagatttattctgtaggagagctcatactttggaagcagcaataacctaggactgctcttaactagcttgatgaccttgtgtgtgtgtgtgtctgtacgtgtgtgagtatgtgtacctgcatgtgtttataccgtatatatggatatatgtgtactccggaactcataatatatacagttataaccattgttcaatcataagctgaatatgcatgagtcactctttcctgcactgaactccattttgtctgtcacaggcgttagatgacagcttagatcatagcctgctccaatctttacattttaataagcaccttttttcaatgccactctgatacaccctctggtccttcattagtcattgctgatattatttctctctaagtgcttcttcctccattttaaagaacaacttcgatgtggttttttttttctgttttttaaattaaactttgtattttgagataattgcagattcacatgcacttacaggaaataatacagagagagcccttgtaccctttccccagtttcctccagtggtaacacccaggacattgacatggatgtagtcatgatacaggacatttctgtcctcacaggacccctcctgttgtctttatgaccactccctccaagccctacccatccagaaccctgacaaccactgatccattctcatttctataatcttgtcatttcatgtagttaaataaatggagccataggtgtgtgaccttttgggattggcttttttcctcttggcatatttctctggggatcatgtatatacactgatatggtttcaatcttggaggaatcctgattctgaaatcctagagtccaaatctgatgatttcagggctgaacagttcccttctttgagtgatgaggacctgaaggctgagagacctgaggtgtcatgcccagggatcacccatggcacagcctgagctcacagcagagatccggcctccaggcccggagcactcctccgccatgaggtcttttacagctcagactgggcaaagctctttttaattccaccaaacctagaattgttaaaaaaaaaaaaaaattaattaattaattaactaaaaacgctcaagatgccctcttactgccagccacaaaggggattctcagccatcccagcctttgtgggcactggagcagccgtggcctctcttggtcctgcctgtgtgtgcaggagcaggcacaagtgggctcaggctgatgcccccagaccaccctcggcctctgacccttgcctgaggctggcctccacaccatgatgccatccaaggaaaggcatctccttaatgcctctgagagttccatttgtaaacatttttgaatgaaggtctctaaagaagcagccaaagggcaggatgtcccacaacacaaaataagacatcctccttatgctgtctctgaccaaagtcctcatgctcacacagctggcccttccctctcttctcttcttctcttccttcccctcaaagaatatcccagcctctatcaaccagcaccgtggctctcatcaagatctttgccggtcctcggcccttgttctccgaacctctgtgctctcttacataaattagcaacctcctctggcatctctaagcctgtgcaccacccattccccttgtcccatagcacaggcagcacagaggcatggcatgccagagaaagcaaagaagggagaagccttaaattcctgtccttgaatatgctcttgccccagacatattgctcatcgggggtcataacagctcgcaaagcaaccttttcacgtacctgagaaactctcccaacgtgtccaagcccgtatagctgagtcacttgacctttcttcactatgacctcacctacctgggccctcaccaatccatccagataattgtaagattgtataaagttgaccgctttctcaatgcattctcttttctcatcaagatatcagaaatctttgacatgccctagaaaaaaatgcatgtgatacggggttttactgtagagcgatggaaatgttttggaactggatggaagtggtggctgcacaatgctgggaatgtactaaatagatgacatggaattgttcactttgaaatggttaatgctgtgtgatgtgaatttcacctgcatacattatttttaaatgcgtatggggtcacttccaaggtgaagtgcccagtcttctttcagacatgaggtgtagctagagcattcatgaaggtatgcaaggaagggctgagatgagcagcaaggggtggaaaggaaagggtaccgaagtgctgctgtgctccacgctggccccttacatagctggagacacaaaagtggggcctttgcgtatccagattcgaagaatttgatgagggcattatcaagatgaaaatgtggaatattgttgttggcaaagccacattaacacacccacatagcacacatataaaagttctaatgactgtctggtgctttaaaatccagggcttaatacaagcaactcaagttaaccaatttaactgtgaaaacccaatcataggcatttcctgacattttgaatttgcaattgtaatgccgttggtgtccatgtagtaaaaaagtgcaatatttggaggatgcgtattttacttttagattttatatatttatcaattggcatgatcttaaaaaaaatctagcattaacaccaaacatatacaagtgttgtatttaatgtctgtgcacctaaatcagaccagtcagaccacttcacctgttgggctctccaaagcttttcagaaacacagcttatcattcacggacacctctgaagaccagaggcattgtctgctgaggctgcatagttgcttagggcctgaaaactttgtatggtagtttgtaatttgcaatgaatcagttacagccagaattaagatgattttcactctaactacaaaacaagtttgactgtaaacaaacctagagcaatatacagagtatatctggaagagatcttccaatacatactatctttttataaatgaagaagcagaacccagagaatctttttttggaaagggaatttgaagaagaaataatttttttaacgtagccggatgcgatggcgcaggcctgtaatcccagctactcgagaggctgaggcaggagaatcacttgaacctgggaggcagaggttgcagtgggccacgatcatgccactgcactccagcctgggcaacagagtgagactgcctcaaaaaaaaaaaaaaatttaagaatatgtgtattcccgttttttacatgtaattgggtatttctaattacatatcacttgttttttattcctgtgatatgataaagaaaacaggcattggttactggttccttgttatttaataaaagaaagaaaaataaacaacctctataagtgttaactaacttggcaaagcaagccttgatttccggcagtcacttagggaagaaagaggccctggaactctggaccccataatatcaaaaactttcactactggaatgcctcatagcatttacagagatccagaaatggaggctgcaaaaattatgactaggtaagagttggctagagacaaggaagcatttccttggccaaaaatagagctgaactctccttgctgttgccagcattacaccacatacatttccaccagttatttgaagaccccttcacaaccaaagacagccagggcttcgcaaggcccagacaccccgctgactcatcccatctgcagcgtgcaaagtgctatttgtcactgcctagttatattccactctgcccaacagaataaatattaagtaagcgctatgtacttacataatttgcagaattgatcggctgacttaaaagcttgaatccccaacaaaagaaaatggagtgctttgtgcaaatgttaaatgcacagtttaattggcaattgtgtgttggaaagctattgtaaaaggatcacagttttgaggtgatgctccagatagcacagtcagggaaataagttttcatctttggcattaaaaaatcaggtcttggaattgaagtaaaaaaaaaaaaatagggcagcctcagtctggatctctgtctcatcagaatataactttcttcctcctacactctgcctcctaaatcagaatttagaacatattaaatatgtaggctttaaagattctttccttgcctaaataatttatacacgtctactaaactgttaaatatcaaagaaacacatgcacatggacacacacactcagagcattttacaacagtgatttccacctcccaaaaatttaagaacgtgctcagcaggaagttagagttgtcaggtcccctccagtggaaacttaaagaaatgtgttgtattttgtttcaatgaggatctggatggagagttcgccatcttgattcacgtaacaaaaataggtgagagatacatgtgatccccgaggagaactattagacttcccttagatgcaaaggttgtctcagtcgtgaaaaaaacgtgtgtcatttcagcctattcagtgcattctgcagcacctgctagaatatttatcctccttctctttccacttaagtcctacatttacataaaggctactggagggttccatgttgaagcaggttttatttgcaaaactcagcctccatggatgtgtctttctgcagcattcctttgtgcctctcattatcacctaagggtttataaaatgggcagtggtaactctagttttaaatctagttaactctagagattaaaatccagtaactctagattaaaatctagtaactctcagctattgtgaacaagttgaagttaaaaaaaaaaaacaaaaaacctttcttcagctgcgactgaaaaagatccagtgataccaagcgtacctagtttccatcctcataaaataatctcttaagtgtaaagaagcccagtgcaaaccaccatgaattatcatcatcgtttcctacagtgagttcggaaattgctttttgcttctggatactgtgaaaagccaggtcaggaatccacaatgggcatcagtcatcattgtgttgctaatacttgccatcggttcaagaataggaatattaagattgcatttcttcattcttccttgccaaagggaggaacaagacagtcaaagggcatggacccctggcccttgattgaaaacactaacagatatgcatgcagttagaccccagtgttcatgtgtccaaggcaataggacttccaggagagacatccaagtgaggaagctgcaagtgctgcctggaaacacctctatcttcaaactccaccctctctggcttggttgggaaaacctcattactctcaattttctaccaaatgatggtgaagaggagtcatttgttggaagaaagggattcattacagggaaacaggtcttgaaaaggatcaataccatggctgcctccttgtccagccaaggggaacctgtgtggctctcccaagcctgctctccttcaggccctcagaagttcatgctgtcattaggacagtcctgcagtcaatggcagggggcgtgatgtcccgaggtgtgtgaggtcttccctgagcaaacctgtcctttccagtgacctgccacggtgcccaaaattctctcatccaacactgtgttagtgagttgcttgaactctggggccaggctgcagaattgagtgccagcttttcttcttactaactggataacttctggcaaaatttaaaatagcagtaattgcagtatctacctgataatggtgttggaaggattctatgattaatacctaggaaaaacttgtgagtgtctggtgcattctactatgcaataacattagttatttttattatttaacctcagtgtgttgtctggcaaatagaagacacagtcagcaaaacacagaaattcgttaatgaagtgaccgccaggcacctggacgagccctgagggtataggcaaagacatgctggtagaggaaggggtaagagagacctgaaaattgaggtctgtccagggaggccgggctggagacaccctgagttcctagaaagagcaagttatctatgagggagaagagaaccattatagtggtaattgtgcaaaaaggaaaaaaaaagacaaaagaaaaaggcagccgtaatcgttagatgccagggacagtgctaaccactttatttatatcatccaatttgatcctaaagcaatcttataagctgggtatattctcatttcatagaaaaagaaacaggcctggagtgccctctcagttagtcgatagtggagctgggagctaaactgttgcccaaactggatccatccagctggcacaggtcataggaaccccggggtctcagcacttcccagatgcctctgttagtgcttcctcttacttggacccagttgtcttaggaaagcaagacagcagagaagcccagctcctttctctcttcctggtacagaaccagcatcagcattatttagaatccagatgtggccaatgtgggatggctggaggagggaacaagctggcagacagcccccacctgggcataggtacatgacaggagggaacgagcaggcagacagcccccacctgggcataggttcatgaggaggaaaacctgccaggaggattccacacctgagtcagggagtcactgggtttttccagcgagcacccctcacgtccatctccatgtttcttcccgaccccttcgctctggaagtgaggagagggaagtgttaccagttgatgttgtttatgtaatgctaggatcagccaaagagtgaacatcctgctctttcaaaatgaattgttggtttgtaagggtgtttgctgaccttttcaccagtaccggggaagaaatgcgcatttatggctctctttttggctttagaacagataatcccagggcccaatctttgccctcttctccacctccatacacacaaggaggcattggtctgcggaaactgtttactcagaggaccagtggccctcgtgcaactgcagtcaccaagttgccatccgggctgcagctttcagctggctctcctctgtgtctgtgctggaggtgatgaaaccccaggcttccacctgccctcatcagggtccacacagggaagggacagccttgtcttgaggcctttcatgctgaatctaaacctccccattatgaattgacgtggtgttacttgggaagggatgatatttctcaaactcctcctgtgggcttgtcacagcgccctgccccttcctccctcatctcagctgcccctcactgggcatcggggacaggcaggtattcttcactttatacatgagaaaggcaggcccagacagggtgggtaccttgcctccatcacatggctcatcagtgctggacaatcgagtatgaaactgccatcactcccatgcctgcctcttctctgtggagacaacttcaacttcagaaaacgttagtgagtcttatcatattcctacagccacattccagaacatgctgattttctcatttcaggacagtttccccaggcgctttcaacttcttataccttaaaagaaataccaaatgcattactcatgtctgtgcagtattccctaagaaaataaagacatctagctcataggaattccagaaagataaatgaaaaataaatgaggcttcagaatgctcacaaaacaaggactctatttgccttaaataattaacattgagaattcaaacctgaccaacttttcctccatgattaaagcaacccagggagagggcaggtgattccagtgctgggggtccctttagccataaatgtatggacgtgtgatgccgtagcactcagggcctgggagagccggggagcatgaggatgatcgaggtctcggagctcaatcaatcagcaagtgcttcttggtcacctattgtataagtagaaatggatgccctatttatttatggaaaccatcaattgttgaggacctaatatgtaatctcatctaggataaaatccttgaccttgaaaatcacaatcagctgggagagaacacagagtaattgttagaatgcaagatggcaggtgccatgacagaagagcaggatggatgctgaggagcacacaggtggggtactagctcgggcctcagagcaggcaggaggacctcatccaggaaacatctctgagttcacttcccaaggacaagtttagccccaggacaaggaggagatccagaaggcattctacaaaaatgctcaaggaacaagggcattggagcacaccatgttggcagggaaacagacaaagaccagacatcagcgcttgctcagaatcctctgctgctctcgaagggctgtgtcctccacaggtgggaggatgccacctgctctgatggtccaagcagtgtgggttcagccagcgctcttggcacctgggagcatgattccaaatgtagacgtaatccagacctgcagcttcaaaaaaggagccaccgtggtcagggtcagggctgacacagggccaggggaagagagtttgcaagtagcaattcaatacttttatttcagaatgtgtagcaagtatttgacatatatgtataaacaaaaatcatataaccagtttcctagaggtagtccaggccatgaaggctgcaacttattgtttctctgccctgacttaaagcatgtgtttccaagttgatgcctgttctttttatgcctcatcaccaccctgagtgttcagtgaggaattgctgcaaggacaaagagttcccaatgtaatgtggatacaaaagaatccaaccactcagcttcatcagtgcccttggcaatgcacgtccaagaagcctcgcacacagagctgggaggccatctgaggtctgaccactgtgcctgccagaagatgagcattctgtttgtctctacagttgtgtgtgccctgtggcactttcacatattaagatttgaaccccaccaccccccaaccctgtgactgatccccacagcctcccctttagcctgggtgaattaattgaaatcataggagcagtcttagctgtgcccgtcatgcggtcccttgagacaaatgcattcggtagatgatacatgacagcctgaacacaggccagggaggagaccctggaaaagcagggacagaaggaagacaacttcccagccagcggccttcgcttcaagacagaatccactctcctccctgctcaccagtaacatgagggctgagcaaatgggaagatggtctttgagagttatcgacttcctccttttccagcaacgacatcatgcctctaagtagcagttcttaggaaacatgaagcccccaaggacagctggctggaaactttcaaagctttgcaggcataaccactaatgaggagcaaagtcgctgtttatttgagatggtgacagacactatcagcacacttcacacagttcagatatgtgtttaggttcagaatgatggggatttcaagaccaaaggctctcgaaaatttcagcaacccaatttattcaccaaagcattaagccaggatctattttacatcagattgtttgaaatagtgatgtaagaaatgtgctcttgatgtggagcctccagaaaaggacttgatgtgctcatgggttctcatgacctctgaggtctttgctgcagagaattcaccagcctagtgcctggcacatcacaggtgctgtgttaactgaaagaatgatgaattattaaataaacagccactgtgatgtggagaggaaagagttgggcacacttgggttcaaagagcaccacctccaaacgccaccttgcctgcctacttctgatggacactgttagcaaattgcttaaacactccaagtttgtgtttccttatcagtaaactagggataaaaatatgtatcttcactgggcatggtggctcacacctgtaattccaacactttgggaggctgaggtgggtggattgcttgagcctaagagttcgagaccaggctgggaaacatagtgagacccgtctttaccaaaagtagaaagaaattagccaggtgtgggggtgtgtgcctatagtcctagctagttaggaggctcaggtgggaggatggcttgagtccagaaagtcaaggatgctgtgagtcatgactgtgctgctgcactgtagcctgggtgacacagtgggatccagtctcaaaacaaaatatgtgtcttgcagtgttgttgtaagccttgatgcactctttcctagtgtaccgaagcagcctaataaatgttagccccccggttgcctttccacttaaagagagatggggtgtattagcccattttcacagtgctataaaggtactacctgagactgggtaatttatgaagaaaacaggtttaattcactcacagttctacatggctggggaggtctcaggaaagttacagtgatggcggaaggtggaaggcaaaggggaagcgaggcatgttttacatggcagcaggagacaaagcatgcaggggaaactgacattttgaagccatcagattgcatgagaactttctatcatgagaacagcatatgggaaacctcccccgtaatacagtcacctcccaccaggtcccctcctccacaggtggggattacaattcaagatgagatttgggtggggacacagagccaaaccatatcatgaggaggttatatcaagtggatttatagaactgagaaacagttgagaggctctgtggtgtgcggatggttttggaggttaaacaaaacaaagaatactaataccagagttccttccttgaagccagttaagatcgtcacactcaaagggaagagatagactttatcttgtctctcccagtagattgataatggcaggaggagaaagggcctttcctatcctttctatgcaaaagtgtggtgtctggaacagcatctgggtgtcaccagacagtcttttggaaatgcagcatctcagcttccacctaagtaggctggcccagaatcaacatgatgaggagatccccaaatagtttacttgcactttgaaaagaaacactggcctagagcaccttcccctctctgggtcgccaggttctttgatttattaagtctctgcagctgactgatatggagggcaagggtacttttgaggaattttctgaatagtaggctgaattcttcaaccagccaaccaaacaacagcatgaatctatcttatactagatacgtactgcttcttctaaaaggctgcagagagggcagtcgtgggcccagtgaacagctgcattctggtcggtcctctttttcccttcctctgccaggaaccacagcagtgttgaggttctgtaagcacgtgcccagttggcaatgagcttatctctgagcatctgaacagaggagaagcccagagcagcctggctccagggaccccacgggacgcattgagtgctgagctaactcagggaggagaccacaacaaatacaaactctgggaaatcagggacagggcaagcctcttgggattcatccccggcggacatgcccagagactgtctgccacagcttttggcaatgacagatcttaccatagggctcctactaaataccctctggaaaagcactggacagtgacccttacttgaggatgcataatcaagggtgtggtcatgtagccatcataacatagggatttggaagattgaggtatgcggaagggccagttccaggaatagagctcatgcttggtccaaggactagggcagggccttcaggagctcgtggctttgaggagggataaaggagaaggattggtagcaaatggcccagagattcttacaaatccaccttcatccataaggaggttggagggtgtatgatgatcctctcttctaaaaggctccctttcaaattacagaaccattgggtaattcttctattacccagggaatcagtgccagctccccaggcactgagtcccaggaggaagacagctcatcttcattcgtgggaacctgtcctatatgtgattgtgcccttgggtaaagtggactttacaagttcgttattgctgttgtttgagcagaggtcatgttttttgtgttactgttgtttttttttttttttttcaaattataaacctcatatatatgttaaagcttaaattcaatctgatgtagagatttaactgtggaagtgaaacctctctaaaaaaaaaaaagatcctaggaaacaactagaaatatgagatttattctaatcctaattgcatgttccatatttagacacccttcccacaaaaggtgagagaaatgcttaccttgtccaattttacgcacaagcctccactttaaggaaacagattactttttttttttaaagaactctcaaattacccattgataaatacagcactcaaatttttttttggaaaaggcacaaaggtaaacagataaaggagttgagtggtcacctcatgacaaggacagtttgagggtttactcttgttttcatgggagcattggtgcgggttacttcatctgaaagaaactttgagctctgaagctatgtctagcacatgttaagtaagagtggtccttggaaatttcaagcgttggtttgcatggaagcacaaatcatttgacccacatgaaaagaatgaaatgggatggaacagaaactcaaatttaaagtattaagtgcttttgtcaactgcaaataacatgtctctgggatgttagtgtgtaaattgggcagtaagattccatgtgtattagaaataaacttaattatttaggaggtagggtggacctcttcttacaaaattatattttctaaaagaaaataaaagcctatgagctatcaacagacatattgttgtaacaacataaaaagtacatctttagccagctttcactcatccaggctagtgcaaataaggtgtctattaagaaatggacaggtcatgctcaaaccttccacgaggctgtggtcccatctcatccctttctcactctgacaggggcacagtgaacttcctagtccattccatgtcctgcccagctcagggtggaggagccaaagagccctgctgtgaccacccaggagggagagagggaagggcttggttcctccacgctgcccaagcctggtctgtctcagagggcagggctgaggaccagagcgcctgtgggccagatctggagcagctggcgggagtgaatgacctgtgattctgcgtcctccctctactgtggtttcctgtctctgaaaccttatttctctcagcatcctgactataattaacatatgaaaaaaagaagccaaataaatcaagagaggctgaagcccttcgcatttaaaatccatccaccatcgtttcccccattttatcagctgtgcatgtgctgagatggattatgcattgacactgtctttgaatagagggtgagttgggatcctggtaaagcagccattagaccattaaaggcagtaggagagatgcaggaagtgccaggatcactagaatctggggtccctaatccacacaacctcacccagccttacaacaagtcctgtcaccctgaactgcccaggcttacagagtaccttcaaagatgtgaaggggcagcttatctttcaaggtaaccaaaatatcatcttgatattaaatcagattacttggctaattcatcagtttccctcagagttaggtaccctgcacatgtcgttgtcacctttagatggcctcatgcatgggaatgtgaattattcataggctttctttgggttgcaggaaaccttcatattgctttagtttcttaatgtatttgataggctctttgtgtatgatcacattatatgggtattgctggcagtacagtaaattttaaattatatagtctgcagctttgcactaagacatggtaggagatgattcatcattttccttgtcttcctgtttacatgcggacatataattcatgctcagaaactatctttcagctcatctggaagtgctccactgcaccaccacagaatctatctctgccagtccagaattgtaaatcacttttctattaaacagcggggctaaaaatgcaaacatatgtactttaaatatatgtagccatctccaattcccagaagatgagccaaaattaaaggatagtcaaaaaagctagtgctagaatttaatgaatgaatgatttgacttgagatcagaaatttgcatttctgtacacatattgaagatatatatacacacacaggtttcccagaatgggcctgtctttgggaactgtgtattctgcagattttgtacactgaatctctatcattctgaaattttacttcctaagattattcactcatgcagagtcacaagacagacttgatggtggggagaaaaggtctgtataaattctcagtttagcatgatatgaagcccttgtctgccatcctcttgaccttcatccccaggccaagacaatgaagtcatttgctcaggatgatggacatctagactcagtagtgagtgcttttcatctccaaggataagattccacccagcaaatctgcctactcaggcagtagtgggagttagatatttcagaaaggttttcagcagtcactgtttctttgcccaacaatacacatcatcatggttctctactccctgaacctgattcagctgtgatagtggataaccattttcacacacatgctcatgaacatctggcattgttgaagaaggaagacctttccgggtaactgaagcttacccattgaagagttttttgtttaatattgcagctgtcttaatggaatccttctgaactgtattatttgcttgcctactttttttttttctttgagacggagtctcccactatcgttctgttgcccaggctggtgtgcagtggcatgatcttggctcctgcaacctccacctcctgggttcaagtgattctcctgcctcagcctcccaagtagctgggattacaggtgcctgccaccacacctggctaattttttgtgtttttagtagagacatggtttcaccatgttggccaggctggtctcgaactcctgacctcaagtgatctgcctgcctcggcctcccaaagtgctgggattgcagttgtgagccactgtgctcagcctgcttgcctactttattaagcaaaggctgccaaaccatttcatttgtgattctgtgattctgccgagaattgtggtggctgtctgtccctgtagaccattggttgccttgccttggagctcacagcctttcacctgtgctttatattcttgtacatttcaagaactagagttccaaaatccggtttgctagacttgtgctatggtttaaatgtatgttctccctcaaaatgcctatgttggcacttaaaccctaatgtgatagtatcaagagatgggtcctttgcggaagtaattaagtcctgagggctctgccatccttaatgggattaagccccttataaaaggggcttcagagagctgcctggccctttctgctcttccattccttctgtcatgtgaggacacagtaagaaaacaccttagctaatgaacataggaacataaaaccaaacacctcacttataagtgggagataagtgatgtgaactcaggacacaaaaaaagatacaatagaccctgagacctagctaactggggaaggtgggaggagagagaggagcagagaaagcaactattgggcattagacttagtacctgggtgatgaaataatctgcaccacaacctccctgtgacatggatgtacctttataacaaacctgcccatgtgccccgagcctaaattaaaagttaaataaataaaataaaatgccactgggaagcagaaagcagccctcaccagatgccacatctcgtaagacatggagactgttggcacctggatcttggaattccagcctccagaactgtgaaaaaatacattcctgttttttctaaagtacccagtttcaggtatgttgttatagcagcatgaatggactaagacaactcatatgataagctgggctgccaagtcctgcagaaatacctgtgtcctcttcctgcacagtacaggtcagggctttcacgaacaagttttgctgtggctcttctggagttccaggggcccttctgtgagtgggttttggggggctgctttcttccttatttcatggtagtcttgaattagtgataaacagagtttgaccatatgtgtggataacatgtacaggtcttgattgaaactcaagtttgaagagcgtttgctgggtgccaggcataaaaacggggttcctgcttgtattaggcctcaccctcgttatttaattacccactaaaggcctcttaacaaagtcactctggccattaggtttccttttattgttattgttttaagacagagtctcgttctatcacccaggctggagtgcagtggtacgacctcggctcactgcaacttccaccccccgggttcaagcaattctcctgcctcagcctcccaagtagatggaactataggtgcctgccaccatgcccagctaatttttgtatttttattagaggtggggtttcaccatgttggccaggctggtctcaaactcctgacctcaaatgatccacccacttcggcctcccaaagtgctgggattacaggcatgagccactgcacccagcctaccactgtgctcgaccctcattaggtttcaatatatgaatctggggggcatcagaccctagcacagcttctcacatagcccctctcctccccacccagcctctcttcttcctttattacttctgttaagtgcagcctattcattggttgaccttttcagtcctataactcagtggcttagttttttaacaataaatcacaggaaggtggcttaactattgaaaattttattaaaatggttataataatgacttcattactctctgaggcttccagatcttctcttcattccagggaagctggctatgtgaaggcatctgagaattgctattaacctctgctgaattaaaaacaggagcggatgaacaatgttggaagtgggccgagggcttttcagagataatagttgtatgatagcacccccagtttaaatataacacttttgcattataaaaaaggcatattaattcatggtaaattgaaaatttaatttaattttctctagatgagtgaggaaaaaaaaaatgaagactccttactctgcttgattcagttaccatggggatagaacatcttttcgggagaacctctgtgacatggcacatgagccctcaccttctgcttcacatgcctggttttgtcgcccacttgctcttcctgatgaatctgccccagcatccaaatagcacaaacccatgaatattctgtaacccattttcatctttgagcctttgctcctaatctgttacctttgacccctatcctcccagccacccaaattgagcatatcttccaatgcacaactcaagtcccaccgcctctgtgctttctctaactccacagccacacacagcctgtcctctggccttcctcaggtcctaacagttgaggtgggcataaaagaaatgagcagatgaaaataatctgctttgtagccaggcgcagtggctcacgcctgtaatcccagcactttgggaggccgaggtgggcggatcacctgaggtcaggagttcgagactagcctgaccaacatggagaaaccccatctctactaaaaatacaaaattagccgggcgtggtggcgcacgcctgtaatcccagctactcaggaggctgaggcaggagaatcaattgaacccgggaggtggaggttgcagtgagccgagatcacaccattgtactccagcctgggcaacaagagtgaaactctgtctcaaaaataaataaaataaaataaaataaattaaataatctgctttgcaacagacagaactctttcagtaaaatatccagatccggaagctcatttcctgcatattttgtctgcctgatgagcccctcctcatgtacctgcatctctttggtgatcagtcttcaaggcatggggtggaaccaccagtgctcagtctggaactccaatggtgtgattggcaggagcagagatgccacagcctttcaggtcatgggaaggctttttggtggttgttggtgttcttcatgtaggaccctgacaccccttccgtaaatgtaattattgttaaaatgataatccttgagataatggaaagcaacccagtgaggctgtggaacctgcattgaaaattgttgaggtagaacagactgctacaggtgagagagtcttggtttccactcctgtcggcatttggcatttttgcatgtacaaagtctgttccccatcccatgacaaaccccaggtgaatcactggacataaagatggtatggccaaggagaagcaaaacattgcagaccgtctctaccagcagaagctcagcaccagggtgcaactcagatgacagattgtaggtaaacacgtgtgcttactacccattcattcattattcattcatccattaacacgttttgcaaatattctttaagcatccattgagtgctaggcaccagggatttgatgatgggcaaatatagaactaatgatacccagtcagagagagagataagaatcaagtgtaactacataagcaaatgtaaaaatgtaatggggacacactctctgaaacctaggagttggtgggagatgctggtaacagcctctgatagtggggtgtaagccagcaagatcagccaagccccctgaggctctgagatcaaattgaaatccgaaggatgagtagaagatgaagaatggtgaaaagaatgttagaatattctaggcagaaacatgtggccaagtcctgttgggcgggggcagatgagaggaaggaagaggtgggagatgtccctagtcctgcagggcgtggtgtgccacatcttcctagaagcaacgggaacccatggagaggctcttggggtgagggtagagtgaggacaacttcacatttgcacacagggaaaatcctcttctcttcagagtggagaataggcaggaggggagtgagcatggaggtgaatagaacactcagaggccactgtggcccagccggggaaacatgacctgaccattccctgggaagacactgtggcccaggaggacacacacactgtcactgggaggacactgtggcccagacagggacacacagcctgactgttcctaggagaacactgtggcccaggaggagacacacagcctgactatccctgggaggacactgcagcccaggaggggacacacagcctgatcattccctgggaggacactgtggcccaggcagagacacaggcagcctgaaccatgatggtgatggttgagtggagagaaatggacaacgttaagagatactatgatgtaaaatccatgtgtgagccaggagaatagcttcaacttggaggcggacattgcagtgagctgagattgcgccactgcactccagcctgggtgacagagtgagactctgtctcaaaaatataaaaaaatcaaataatacaataaaataaaatccatgtggcaaggtgacccactgattttgggttgttaggaaaagagaggtatcaaggatgactgctaagttctgtgctctggataaaaatgaaactcaactttgaggaaactgtgtactctaaatgtttctgcattggtctcccaggccattccaatcaactgcaaagcttcatctttcataaaacatgaccttaaatgaagacttaactatattctaaagtttgctgtgtacattaaataccatatgtggtgaacatttccaaattccttaactgtgtgacacttcatttgtttttggtttcaaaatggaaatcacaactgtccccaatgtatagagttagattttaaaatttaccaatactaggcaattgcacaaaagatttctagtaatgtccacaggaaattaacatcagcaacacaatttgatgacgtaagagggcttttgcaacatatgatcagttccttcattgttaacattttaaaaacattctgatatcagggctgggcatggtggcttatgcctgtaatcccagcactttgggaggcagaggcgggcagattacttgaggccaggagtttgagaccaacctggccaacatggtgaaccccgtctctactgaaaatacaaaaattagccaggcatggtggcacatacctatgatttcagctacgcaggaggctgaggcaggagaattgcttgaacctgggaggtgaaggttgcagtgagccgagactgtgccactgcactccagcctgggtgacagagtgagactctgtctcaaaataaataaataagtaaataaaaataaataaataaaaacatactgatttcagagtaagcatatcatacacaagaaattacctttatacctcgaatcccttttgatttttagaaaaataagctcagaaaatatgcacttttcttagaatagtctgcaaaaatttaagaagataagagttttctttcagaagacattatacagcctatatattttaaaatagaatatatatctatagaacaggtacatgattttgagcaaatcatgttacctctcttgaccttgccttctttcacaatggatactccaattacgtgttatccaggttcgttttggcttttacgattgtttaattctactttttcaatcccacttcctttacccagtaataatattcattggtgtttttcccttaatcgaagaaaaaaaatgagaaaaaaaaatctcattggtttgggagtctactctgtgacaggctttgagcatgtgtatatatcttattagtaatctcagcacctgtaacacttgtgtagggaatgtttcattttacctattctatcgataaatagcctgatatttaaagaacagagacatttactaacttttctaaagttactggaggcaggatgtaaacatacgaatttctggcttcaaaaccaaaattcttttcctgggtcattagaatcccccatctaccaatacactagtgcccaccctctctctgtggagtcagtaatactttaacttcgtatagcaagcaatgcttcaaagcaacctcacagttttggtcccactaccccttaaaattggaaggcaattcatgttacccacttttgatgaatgagcaactgaagatgatccagcagcagccaccaagtggctgagacacaactagaaccttgtctctctattaaatgcatttcctgatgacacgatgctgaaccttgagactcacaggagattaggcccatggagaagtgggaggaagaggaacaggggaggagaaaccatggccagagttctggggctgaaggaagatgagagggaaggtggagtcctcaccaaatggcatcatgtctgcaaggtgctctttcagaaattccagtaagatccaaaagcatcttgccaatgaaactagaaaccatttgataggttcgatctggacaatttttgtcttatgccagatgtgagttgatgaatgtcaaatgatagtttcagatgtaaacagcagggttcctgaccacagcagaagagcagagaaaggaaggaacccttcagctcacagaatgtgaaaggcatcagtaaataggggagcatcagtgcccatcactgtcaagggattactccaagacacagggattcttcggggggcctttctaatgtcttaacatttaatagaattgaagtgtctttcttcgtacagtattgcaatccatgtagtatgggaactttatcaaactccagaatatgtgacagtggacatgtgatcctattaccaattttttcaggatcgactctacatgggcatcctcagtaggctctgctgtcaaaaatccataattaatgctgttttaacaagtgtcaaggcaaatgtggccatttgtagagaggaataattatttgcttatttttggtggtatgtgatcttcagagtcagagaaagatggggcttacagtcaggtgtcaattgtcagtaacgtgcccttgacttccaggaagttccttatctccttgaatctctcttttacacctagtgaatgggatgacagtttccttcaaccagtttcaaggatccagtcagataatagatggtaaagtgagccctgtgctattggtggcaatgtaaaatggtgcagctgctacagaaaactgtacagagttccgtcaaaaaatcaaaaatagattacaatatgttccaataattccacttctgggtatttctccaagagaagtgaaattatgatgtcaaagagatatctgtactcctaggtttgctgtagcactattcacaatagctgagatgtggagaccacctaaaagtccattgacagatgagtggataaagaaaatgagggacacacacacacacacccctaggaatattaatgggtgttaaaaaaagaaggaaattccgccatatgctacaacaaggatgaacctagaggacattatactaagtgaaataagccaatcacagaaagacagatatgacatgattccacttagatgagagcggaatggtggttgccagggggttgggagaagggaaagtggggagttgctcttcagtgggctgtggttataaagtttgttattgcaaaatgaataaattctaaaaatctgttgtataacattgtgaatatagttaacagtattgaacagtcactgaaaattttaagatagtagatctcatgttatctgtttatatcacaataataatattaataataacaaaagtttcaagcaccatggcagatgtatctaagaggtcttcctcctctcaccctgcccctcactctgctcctctcccctacactgttgacatcctcctggactttactcagcctgcttcacaaggacaggttcagggtgggtaagacttatttggggagattgtcattcaaaactgaaggagtactgagtgccagacactgtcatgatcagagggtggaaacccctgctatttgaatggatcatcaggcaaaatgaggaagtgtcaggaattgccctatgcctgccttttatcctatgattcagagctctcattcactaaagctacaatttatttaacctgctcagaaatttcaggaggaaaatcagtggatgagaaatcaataataatgaataatctcccattcagaaatatcattagagattatttttcattattccactggtaacagcaaatttaaaagatactgttataaactccatagcccaagcttaatagaattaataatcaaatgggatcctgagatcaataattctcaaattgttttttgtactccaggaattcccagtgtgtacttcaaagtgaatctgacacttcattttaaaaacaatttggagtgacttttgtccctatgaatgatgccaaattgatagtttaaaaattgatgggtttaacccaacaatgaagagactgcaactaatcagtccattctttccttctgcaagggtccttggctcatcaaaccatctcgaagtcctcatttaactaattttattacttgatctacaatttatttcaccccagccacaaaatagaccagtacttagggataaaagtagctgacacaaattttgtttcaaataggtcattattttatcttgatatataaatgtcaaagataccgcttgggttcaaatggtgccagaagacagacaaatgggcaggctatcagagagaaatggaaactgggaaagaatctatttctcttcattttagtaagaacctaagatattgtcctaagcttacaattgcagggacagaaggagaatctgaattagcattaaaaatgattttttaataatatatataagggaacttttaaagttcatggaaaagtggacttaaaagataaaattaaaaacattaactttatttctcagtataagctccatcaagttcaaaacactttttaaagcaatgatgtcagtcatttagtccatccctaaagaactgagggtccctggaatttagccatttcaatgtaaccttttttacattattaactgaagaaaaataggtgccctttacagattttgtaagattaggaaacaaaaagaggtcaaatggagccaaatcagtatggtaaggtgaatgcctaatgattttccattaaaactctcacaaaattgcccttgtttgatgagaggagtgagtaggagcattgtcctggtggagaagcactctgtggtgaaggtttcttgggcgttttttttctgctaaagctttggctctctcataataacacattatagttatttggccctccagaaagccaacaagcaaaatgccttgagcatcccaaaaaacttgctcttgattggtccacttttgctctgactggaccacttccacctcttggtagccattgctaaggttgtactttgtgttcaggatggtactggtaaagacatatttcctctcctattgcaattctttgaggaaatgcttcaggatcttgaccctatttgttgaaaatttccattgaaagctctgctcttgtctgcagctaatctgagtgcaagggttttggcacccattgagtggaatgtttattcaactttaatttttccaccagaagttgaagcaattgagatagctatagtgttggcttttgtttttgctgttaattattggtcctcttcacttagagcatgaacaagatgatgtttttcctcacaaattgatgtggatggattaccactgagggcttcatcttcagcatcatcttgtctcctattaaaacaagtttttttatttgtaaactcctgatttttgaggggcatttcttccataaactttttataaagcatcaattattacaccattcttccgtccaagcttcaccataaatttgatgtttgttcttgctgcaattttatcagaattcatgttgctctgatggaggcttttttttcaaactgaggtcttatcttttttaatgcatcaaactagatcctgttcagacatgttataacaaattagtacaagcttatttggtgcaaaatattttgtgaaacccatgcatagttggtttttataatacacattttttcatgaactttttgaagaacttacatataatatttcaatagtggtttatatatattttaaaatgttttagccttataaaaagattagagaaaaaatatttctggtttgggaattgaacatcataaaggaaagttagagtttgcaagatctgaactggccacctgagaagcagctacattatccacatttccttctctgcaccctcctccgcaccctcctccaacccctccctcctatcctctccccatcctcccacacagatatggatctgatggtatgcacgaagcacatggaaaattctgtggaaagacaagaggaataagctatggcccccactcttaataggaagtaggtaaagatttgctctgcaaggaatgataatcaacaaactatttctcagttcttaaaaagaagagataagctagaccttgattagatgcagagaactgtcattagagatgagtttctcttgccttctttccccctgttgctgtgacttcttcatctttaagggactgatgcagcttcatttccacgtgggtcttgtgcctttggattccagctaaaagctcctcccagctgtgaacctgggtcatagcccatgagagccacaagggacttgagtgtcttctggttcaaccacctcattttacagttgaggggctggtgaagggactttcccagtgtccccctgagttagatgtaaagattggggctagcccaaaagctgtctgagcctcagccatctgtcactcattcctggtgcttctctcacctcctcaccaaaagacaaacactgtggtttatccaaaagtggccttgcagattttctgattcatgtctttttgccactcaaaaacattgactgaatgagccctgagtgccggatactgttctaacctatagactactgtgtgaagagtagaattaaagtaaaacaaagacaattataacataaaatcagtccaaactattctacctgtaagtgcataaaatgataatatgcatttttgcatcactgtaaagaaaagtatttcatgtcaccagttccattcagagcactgtaattggcaattacttatttttgacatttgtaagacttcttgaaagatagaatttgaatgctgcatctagtgactgattcttcttgcatattgagctgtttcattattttctactctgctttaaacttgaatcagtatagaaccctcccacattcttgacagggtcctctttactcaagatcttgggatcacaggtttgatctggatcaccctgtctcgtatcttggaaatgatgtctttgacatggatagagatggctagcatgactttgatttgttgtctgtgcctttccttgtggcatgagaggaggctgagaaatactgggctattgtgaatgggaaatgagagttcttacaggcacgctgagcatcccagttttgggcattcagtccaagttttgtgtgaggacatcaggagcctccctaggaatacgagtacttccttcagtgcatcaggcagtatgattagaaccacgatgtaagtgtcaggataacatcgggcatgagagtctgttgctgggtctaatagcataaaacaggaggtggtcacagcaagtataagcactgggaggtgtcggcatggaataataatactggtgcaaggagtgggcttaacatcataactgggaacccagaagccagcaaaatgcaaatcagacaggcaggcagcttctgtctcccttctgtgtctctatgcctgcagtgaagactacctgttgtctctctcctggagcacttgcgagccacagatgagagaggacctttcagtgactgattacagcctaaaggctccaggaaacagccaccactgcgggcttcccccacgtgcttctctgaaaggttgtcagcagtgtattgatgattttcaagtatttgagcatacttgtagcccttgaggtcaaccggcttccttggagatggccattctactctaccagccagggaggaactgtccatggtgctgcttcgcatccagaggctacagggttgccgtgtgataggagccacctgggcagggacttaccctcaaacagcctcgtgtttcatggtgcagcactacagggacaaatgcttacctttgggccagtggagagcaatagcaatcaggacttgggagggaacctaagaggataggacaagctgatagggtgagtggggtgaggtgagatgacaaaggggcaggtactgaacaaaatcaggctatctaacaggcaggcatgctctttaatgggtagggtactatccagtcaagtgtaggccaagaaacagcaatcaagattccttggcccagaaacagggtgtcccagcaaacacaagagcccagaaacagggactctgcaggtaggcacatttggaagctcagggaggcagacttctcctctggagtgatcatctactgatagcaaaatcctagtcaccagggagggctttggtgtcaggacctcaatccctggaaagtagataagtaccatcagaacaagaaactctgtctggattggaatggtgttaagggcatcttgatatgttattcctgcttaagtgactcttaccttccatgaggttggttgtgaatcctagaggctgtgtatggagaaccaatggccctgttagaaagggtggacactgggcagctcatcccacattcagaccctttgcagcaggtctccatgttagcatgttctattttgacaaagccttttgtcctgccaggcatttaatggacttcacacattctacctgcggagctcacatcagggtatctatatctgttcctctagctatatttgtgtttgtatcttgatgctgccaagcatagggaaggcagggagaagccaaaagtcagcagaaaacagctgagataaatgacatacaatgcgggaggaacgcagatggaaatagatggcatgggagtttgaagaagcaaggagccacgaagtgctaaagtctgcaaggaggttctcaagctcatctcactatttatatcacagattacagatttcctgctcgtgtcaaaaataagtcattgccagttgctgtgttttgaagaaagaatcatgcttaaaattatttcacttagaagctcacaaatgaaactgttgactctaaggaataaactgtgtagatagtaagtcttaccagctgtgaattagagtagtttgtgagagtcgaattcagacattttcttttttgagaaaagctggaatagaaagggaagcacttctgccaaggttaacagtaggatgtctttataaattcgatgtagctgtgagggaagggacttctgcaagctttcgtgcatttgctcattcaataataatctgttcatcagtgcagtgacacaaaatatttacagaacacagcatcagtggctaaggagcttataagcaaatgaaatgttaggtgtgttatgtgtgggttaaatggtgcccacccgaaattcatatgttgaagtcctaacccccggtgactgtatttgactaggggtctttaccaaggtaatcaagttaaaatgaggtcattagggtgggtccaatctaatatgactggtgtccttatgaaaagaggaaatttggacacagacacccacagggagaatgccatgtgagatggaggcagagatcatggtgctgttccgacaagccaaggggcaccagagattaccagcaaacccaccaaaaacttggagaagggcataggacagattctcttacacagcctcagaagaaaccaaccctgatgacaccttgatctcagacgtcttgtctccagaaccatgagatgataacttttctgttgtttaagccacctgatctgtaggactttgttacagcagccctagtaaacaaatactttagaaaaagtaaaaagagaagcgaagcaaaacttgcatgcacaacaggtatgatgatgctcatgactacagacagtgagaaaggctgtgggttggattactctggctcagcctcatagaaaaattgaggtgaatgtttaattgagtgtggggttggtctgaagagaaagaatagaaaaggagaatcatatttcatacccttactattcagtcagctatggaaagcatatttggggtggctagaagatgccaagtacagtgctaggtgatgaagcagtgaattaagttaggacaatgtggcccatgtagcctctcaacaggaaggcaggttcagatagaggaaacagcaggaaaaaggtgacaacttgaaaatgagtctcttcctcattcaggtagctttggtgctttgcccactggttgtataagagaatcctgggaaacagcctatgagtagtatttgatatcttgggatgtgggaggtaatcagatttcagtgatgataagacactcccatctctgagctgggtgtttcccagaaaattccaaggacaactggcctttaacatctctctctatggttaacttgctaaacattatccagaaatagccagcaccaacatctccttcaggaccccaacagccaggcattttctccgtagactttgctccaagcctcttatttctgggtttggatcctacctttggacttgaggggcttagatattatcacttaggtggacaaaccatccagttaaacacacacacccacacatacccaacacacacacagacacacacatacacagaatcaacactcaacacgcaaacacccaacacacacatgcacacacactttctgaagatgagttttctcatttatgaaatgagctcatctggacttgccatgagggtccaacaggtgccatgcaatcaggtgtgcactcagtatgggctgggtggagatggccatctcctttcccgtccaggcctggttcctgtgtgctgggcctctgctcttcccacctcacacagcccctgcatggaacagagccggccctgggaggcctgggatccccgtgcctcccttcagcccctcttccaaaatcttgataccggacacacaaaggacacagcagatggccattgtatgatgggttttgttctgttttgttttggtgacagctttattgagatgtagtttttaccatacaatttacccatttaaagcatacaattaaacgttgtttagcctatgcacagaattgtgtaatcatcaccacaatcgattttaggacatttttatcacccccgaaggaaactgtgccccttagcagtcactctgcatcctctgtccccaacccctggcacccaggcatctgtgatcactctgtggatgcacctgttctggtcagctcatccacatggtatcatatcgtgtgtgttttcttcatctgacttcttccctgagcgtcatgttttcaaggctcatccaggtggtagcctgtgacagtgcttcatgcctttctattgtcaaataacgacacagtgttttacaacccctttccacataggttagtatcaccagtgtgcttggatgaattgcagtttgcccagtttgctgttccaaaagctagagaattcctttttttcttttttcctcttactatacaaaccaactctaagtgataattaaaagcgtgagctttgaatttaatcagcactttgttcctttctattgtcaaataactacacagtgttttaaagcccctttccacataggttagtatcaccagtgtgcttggatggattgcgatttgcccagtttgctgttccaaaagctagaatccctgtttttctttttttccccttactgcacaaaccaactcgaagtgataattaaaagtgtgagctttgaatttaatctgcctagattcaaaatttgccatgccatttcttaggtgtattacctgggcaactactaacaccttgttacctcagttttcttatctttattttatttatttatttattttgagacaaagtctcaccctgttgcccaggctggagtgcggtggtgcaatcttggctcactacagcctctgtctcccgggtttaagagattctcttgcctcagtctcccagctatctgggattatgtgcgtgcgccactactcccggctaatttttgtatttgtaataaagatggggtttcaccatgttggccaggctggtctggaattcctgacgtcaggtgatctgcctgccttggcctcccaaagtgctgggattacagatgtgagccactgtgtccagccagttttattatctttaaaatgagattaataataataccaaacctaataggaatgttgttaaatttaataatttggtaagccattaaatcacatgaaactatacctggtacattttaaacacccttaaaagctaaatattatatatcatattctgctttttaatataaataggtcacacaatatatcagcatgcctatagaggcatttcatccttaatgttacttaacacttcaatttattacgaacctaaatggccagaaagctcaggtaaacaatttcccctataattttacgcaacaaaaattgggatttataccaatgatctcaaagtagtttaaattcttaggataatttcttagcccctgatgaaagattctcttcattcttttgaatgatcagtgtaattgtacttctagggaagatatagccgtttatttctcactaaaccatgacctgtgcatgggtgaggcagcccacagtgagcctgaatgtttggccaatccattccttatgtggactcatggaaagcctcagcctataatcagatttaaagaaatctgtagccatatgtgtttccctgacgtcggtattgctgggccatattaaattgctttacatccctaataactttgctttctattgttctctattctgctgcacttacacaaaagctccatggcagagaaattggaaagaccagtaaaaaaataaggaaacaggatattgtgtgtcctggagggtttccccggtgctccccagcctccattgcacaacctccctccacacagccccgccccatcacaatttccaacccctttactcaccccctgtgtctcatccactttcctctctgtcaaaacccacacttagacattctcagagtccttcccattgaggtccaaacaactagtgatggtttaaaatcttacgactgggcgtgagggaaggcccataccttgagataaagctaatttgaagctgatggcaggatttccaacagcagccagaggaggggcagagtttaggggcagtgttttgtcctatagtccttaaacctgccttggatgtggctggttctgacatcttgaataatcccttagtatcttgtttacaggtgatgacacaaacaagttatctggaaataaaatgaagggggaatgaaccaaaccactttaaggtagctacttttaacagttttagggggtcagttcaaaagtctttataactaaattctgaaatacagagtgccctgttttcaccttcaggggtctgacacccagtgttaggtttacagtgtgctgtgggccattcatctgggccccaatgagcttagaaaacaactaagtgaacagcagatcctcagccaggtgcctggccccctgttgacctcacctggggtctcattcactgtcccaccttccctggaccaggcttccccctccactgtccacttaccaaagagtcacaccatttcatctagaaaccctcatctccttcttctttttttctcttttccttctcctccttccagctcctaaaatagaaattaatgtagtcctggcccagcagatgcttcagggatctgcattctgttcctaaatgctcagatactcactaaagacaaatagaagtgttgggtccacagtggatgatccctcagtacatcttgaaataataccttgttaaagaaagaaggtcatatccctgctgaggggagccctgggagcgtgtaagtccatctctgggcagggaagctgaccagagatgcagctgttgacatgcagagagaatgagatgtctgaggacaccctctgccagctcgtgtctgagagaggatcccagggacgtgctggtactgagtttcccctctaagcagaagggaacacttcagattccaggaggacatcgaagatgtctaacggatccttttcctcaccaaagagatgtgttatttggtatttttaataacaccatctgccagtgagaggaaagctccgaattgcaatattgatcttgtcactttggggaacagtttgatatttgggattataaataacattttcatttgctctgttatcatgctcaggcagtgtttgatggctgagcccaagaatattattttcttatcaaatataaagatacgtacttttcctgaggtctgaactctgggttgtgaaataatattgacacatattaaagagtaagatgtattctgaaaccttaacaattcagaaggggtgtaaaatttttctccttaaaaatgaaatcgaggacaatatgaggtgataatagcaataactggctagcgtggattaagaggttaagtcagagtcggattagactgtctgatttaagtaacacgatagcctaacaaggaagcacagcagcactattgttcccatgattcagaccagcaaaccaagatagccactgccacggggctaggaagtagcagagctgggatttgaactcaagcacactggttccagagtccacgctgtgaatcattatactctgtctttatttgcacctacatgggaatggattctcttattattatgctatagataccttcaatatttctttctacatttaaaactattctctcttgatcctcatgaaaattatttgagatacacaggacaaatactactatcccagttttacaagttaaaaacccaaggcccagagacattaaacgattttcctcaatgccatattggaagttaacaacagatcgggcttcaaatataaatcacctcactcaaatacatgtatctctttgatttgagcaacacaaaattattaccattattgtcattattgaaagaaacagttgatccatttgaaagataagctacactgtttgtgcttctgggtggctgggatggtaaaggaaatgcatgtggaggcgtagccagcattttgctagcaagctccacaagaatgttttacctaagttcttaggggaaggggaaaatggtcagggccaattctttcatggtaccgagcttcagacactttctgtccaccatttgtactccctctgatttcccgtatggaattgaggtcttgcattttcaagaaaaatggcaaaacaactccaaaaacatgtctttctagtgtcgtagctcttagtagcttccttatacagttgacccttgaacaacacgggtttgaacggagcagttccacttatatgtggattttcttctgcctctgccacccctgaaacagcaagaccagcccttcctcttcctcctcctcatcctactcaacatgaagatgaggaggataaagatctttatggtgacccacttccacttaatgaataatattttctcttccttaggattttttaataacatttctttcctctagcagtcactttattgtaagatcactttattgtaagatcacagtatacatacacagaaaatgtgtgttcatcgactgtttatatcattggtaaggcttcctgtcagcagtaggctattactagttatgttgtggtgaatcaaaagttacacaagggctgggctgggctcaatggctcatgcctgtaatcccaacagtttgggaggccaaggcaggtggatcacttgaagtcaggagtttgagaccagcctggccaacatggtaaaatcctgtctctactaaaactacaaaaaaaaaaaaaaaagaaaaagaaaagccaggcatggtgtttcacacctgtaatcctagctactgaggtggctgaggcaggagaatcacttgaacccaggaggcggaggttgcagtaagccaagatcgtgccactgcactccagcctgggagacagagtaagatgctgtctttaaaaaaaaaaaaaaaaaaaaaaaaaaaaaaaaaaaaaaaaaaaaaagtgatacaaggattttcagctgctcggaggttcaaggttcaataccttaaacttttgcattgttcaagaactaattgtctatgaattttgtaaaattgttcagagttgtaattattatctttgttgtaggttttaaggaaaaggatcaactcttcgttattttcatctctgtatttagctaagtttatgtccaatggggtaattctaaccatattttaagatactgccagcgtagattgtctctgttaccaccggatgcctctggagaatgctgcatgcatcaaaatcaagcagtaaggatgaaaaaatctgctctttcctgaactgaccagccttccctgactgtgcacactgattttatctcaatacagtccacaggcttttgtctttctatgagcttttccttctataataagaataggaatagaaaatgaccactaagttctccatcttccatcccatgcctcagccaaggcaagaaagagtgaaataactgctaagctattataaataactatctcctgtaaaatcatgaacatagagtgtatgtcagagatgttggaatcctgcatccttaatgtttaatggtgtttcctacaaatgttccctgagtattcccagtttggtgatatagtccaagctgcagagggaaaggatgtaacctgatattcatattcagttttccacctgatttctttggggattcacctcatttcctcaagtcctgctaatgtgtacggtggtaattccagcattctctcctcggaatatcaacaatgacagtttcttaattgctctcagtggattttatgtaggatagacagtgaggtttgaccacttgattcatttgaaatgagcaatacttccaccttgacatgatatcatatacttggtattttcatgatttattggtggcctggaccaatatactttgggtcaaaaggtgtgatttaaggaattcaacctaagaatagtaggccagctcattctcagtcattatgtgatttgttggaatattgtgaagttccgttgataaataaattgatgaaaaccttttttcttaccatgtaaccacatactgctttgcaccaatgattgggcacaaatataaacatattgctgcacagtaggtaattcaatatcaatatgtgtgtgtgtgtgtgtgtgtgtgtgtgtgtgtgtatatatatatagagagagagagagacacttttatccatttaggaagacaaacatattcataactatgttttccattaaagtatgttttccattaaaatgtactaaataggagagtaccttcctgtgtttccctgttttatccaaattctcagtgtttttaaagatcccattctggcaggtcatggtgactcacacctggcgtggaggtgagcacctgtagtcctggctatttgggaggcggaggcaggagaatcgcttgaacccaggagaaggaggttgcagtgagttgtggtcactccactgcactgcagcctgagtaacaaagtgagaccctgtctcaaaacaaaacaaaaaaaagatccaattccatccccatctactccaaaatgcctccctatttattcttatattgattaatgtattcttcctcaaaattatattactttctgactcaatatcatacaaaccggcacttatcacatcttgaaatttcccgaagctaacacgtgtctaacctgtttcccatattatgttttaagtttaaaaagattgtctgccgaccgaaaaagtttatgtcaaaactacagaaaagagccatttcttccatttctctaaaacatagccctgtgtcatctctgcttttccacccacccctaccccaacactcatcctacttaccttcctctggcattcacagagggctgagtttctagtagatgttaatcaaattctttgcatgtgattgctcagtctcttttaacttgaaaaggggaaggcagtgtaatagaacacaggaaggagctgttcataggttcagaagtcactcttggattttcaatatttgtgtttcattccttagaaagtgctgtcagttccctctttgaggagctctctgaaacaacaaagggacctgtcatttgtgcatacccccgactggcacctttgaaatgttatccagtcttgctacctaccatttctgatttgtctgacgttgacatgtacacaccctggagcaggtctgttgacttcactcaggcttatggaatattgcatacatccaccgtactccataaataactaatagtgtgaagcagagatcagatcaactgacagactttgtagaatgtaatctctggtaacactgactttaagaggcaatgagtgtgtgtgtgtgtgtgtatgtgtgtgagtatatatatattcccataggctagcaaatgaaaactgacagtgaacttttcctctagctctgatagagtgactggcattgggcatttcctcctggcataaacaactctaaagctggtaaaatgtgcatgacaaatgttttaaggcattaaacaacaggcagcacagaactgtaattcttgagagaaaggaaacatgagaggtgaggctcagtttgccccagtgctctgcctgggaccgtttcctgcacatctccagcagaactgtggcctcactgacctgaggaggagattggagctgtggtctcagaagcagctgagatttggggagccaagtgcaagagcagaagctgaggacaagggtttccagaagtcttgatgaagactcattgctggtttttggctgaaggctgcccacaccatggcaggcagtacacagggcctagcagtggttgccttctgcagggctgggaatgaatgaaggcattattgctatgcaccaccaggagatgctggagctccagctcagccagaatggagagaactcattgagcatctcagtcaggcattcagttgaaacctcagaaagtccacaccatagcagtaaaagctataccctcaaataagggccacaccttagcccataactagaataagttcatgtccatgaaaggaaagacatgaagcctggtatgaccaaaaagatcagttggtaatttccctgctgccaaaacaaaactcagagcacttctaatttaaaaagagattatctagaatcatgaaaacattttgtctatagtatccagaataaaatttttttaaaaaattgctagagtttcaaagaaacatgaatataagacccatgatcaaggaaaacaacagtcaatagaaacaagccctgagattaaatgcctttgatgttgaaattttcagacaaggattttaaggcagttataaatatagccaaggaattaaaggaaaacatggtcataatgagtaaacagagggaaagttgcagtagagaaattataactgtaaaaaataaaattttagaactgaaaatatgtagtagatgggtataataatagttaagaatggcagaagaggccggggcacagtggctcgtgcctgtaatcccagcactttgggaggccaaggtgggcagatcacgaggtcaggagattgagaccatcctggctaacacactgaaaccccgtctctactaaaagtacaaaaaattagccgggcatggtggcgggtgcctgtagtcccagctactcaggaggctgaggcaggagaatgatgtgaacccaggaggccagagcttgcagtgagccgagatcacgccactgcactccagcctgggcgacagtgcaagactccatctcaaaaaaaaaagaaaagagtggcagaagaaatgctagccaaactgcaggcagatcaagagaattatttgacctgaaaagcagagattaaaaaaaaaatcaaacaaaccgtatctcagtgaactagcaggacagcatccatgtggtcaaaatacatgtaagttgcgtctcaacaggacagaggagagaaaaaaattgtaaaataataaaacttttctaatatttagtgaaaaaaattaaaatgcttattttaaaatttcaagaaaccccactggtataaaaacaaagagaaccactcctatgccccaagataaccaaattactgaaaatctaacccaaagagaaaactgtcaaagcagttagagagaaaagacacgttatatacaaggaaacagttctaattaatagtggatttcttgtaagaagatgcagaataatattttagagtgccaaaagaagaaaaaaatacaaatctattgaccctaaattttatataaagcaaaaatatcctctactgtgggtaaaataaagacattttcagataagtgaaaaacaataaaattaagagtcagcagacctatactgcaagacatattcaaaagaagctttcagaggaaagaaaatgaaaccagaaaatgataattacagtatgacatgaaggataccaaaaatagtaaatatgctaataattagaaaatctatgtgtgtttgtttcttaattttcttgaagacacctgactgtaaaatgtatgacaataacaacatagaggatacaagtaactggaattaaactgttataaatgttttaagtttatgtaaattgatataatattgactgtatataaactatgagtaggtaaggatgcacattgtaatccctagagtaacaaattaaaaaataatgcaaagaggtatatctaaaaacctaataagggaattgaaaatggaaggataaaattctttgattatccccagagaaattagaacaagaggaatagagaaatagagattaaataggatacacagaaatatatgagtataggaaacttaaaactaaacttttcaataatttcactagatgcaaattaattaaacatccccagtgaataatcagttttagatttaaaaattgaagacataactgtatatctaaagggactttttttttttttttttgagttagggtcttgctctatcacccaggctggagtacaatggcacaatcttggctcaccacaacctctgcctcccaggttcaagtgattctcctgcctcagcctcccgagtagctgggcttacaggcatgcaccaccatgcccagctaatttttgtatttttttggtagagatggggtttcaacatgttggccaggctggtcttgaactcctgacctcaagtgatcctcccgcctcggcctcccaaattgctgagattacaggtgtgagccactgcaccaggcctacaagggactcactttaaatacagagacacagataggttgaaaaggaaagaatagtaaaagataaaccataaaacagtaagcataaaaaagctatggctggccaggcatggtggctcaggtctgcaatcccagcacttttggaggccgaggtgggtggatcacctgaggtcaggagtttgagacaagcctggccaacatggtgaaaccctgtctctactaaaaatacaaaaattagccaggcatggtggcgggtggcctataatcccagctacttgggaggctgaggcaggagaattgtttgaacctgggaggtggaggttgcagtgagctgagattgtgccactgcactccaggcctgggcaacaagagtaagactgtctcaaaaaaaaaaaaaaaaagctatggctatgttaatatcagaaaatgtagacttcgagataaggaatgctgttagaggaaaagagagatatctgataataataaaatggttaacttattagaaagatataaacatctatgtatatagtagctgagctttgaaatacctgaagtaaaaaactgacagaactcaataaattcgcagatatttggatattctaacattctcactcagtaactgttagaacaattaggcataatttcagtaagtatatagaataaagaacatagtcattgtgacttaattgacatttacagattactccaataattgcagaatatatatttttaaagtgcaagtagaactcacattatgttgacacataatataacaagtattaaatcttaaagattatgtcctttaaccacaagaaaattaaattagaaatccaaaacaataagatatttagaaaaagcataacatgtttagaaaataagcagtactctcctaactcatgggtcaaagaaagtacaggggtaagttaatacatattttaagctaaactgtaataaaagaacaatatgtcaaggctttctggatacagctaaagtagtgcttgttgagaaattaaagctttcattgtttaaatagggaaaaaaaggataaaatcaattatttaaattttttcttcaagaagttggaaaaagaaatacaaaacctctagaaagtagagaagaaaatgtgaaagaaaaaataaaatagaaaactgacaaataatggtgacaacttacataaatgaagagattcgatattatcaagatatcagttctccagcaattgatttatgggattaatacaaggtcaacgaaaattccaacaaggtggtagaaattgacaagcagattctaaaatttgcataggaattaagtgatcctagaatagctgaaacagtcttgaaaaaaagaacaaatttcaataacttccacaacctattttcaagatttactatgaagttacagcaataaagtgtggcattagcataagaaaagacaaataatcaacggaactcatttctgaagagtccagaattagacatacacatatacaaccattgatttttgataaagtaggaaggcctagatgaaattatggggaaaaatgaactttaacctctacctcacaataattaattttagatggatcatatatctaaatataaaagctaaaactaggaagcatgtggaagaaaataatggaaaatgttacaacttttgtgctggtaaagacttctcaagtagaaccgaaaaagttcctaccataaaaaaattgatcaattggactttatcaagataaaaatttctgctcatcaaaagacattgctaaaatgaatcatcaagggccaggtgcagtggctcacgcctgtaatcccagcattttggggggccgaggtcagcggatcatttgaggtcaggagtttgagaccagcctggccaacatggtgataccccatctctactaaaaatacaaagatgagccaggagtggtggtgtgtgcctgtagtttcagctacatgggaggctgaggcaggagaatcccttaaacctgggaggtggaggttgcagtgagccaagattgcagtactgcactccagcctgggcgacagagtgagactcagtctcaaaaaagaaaaagaatcgtcaagtaacatattagaaaaattatattcaattccatttgtgtgacaaaggacttgtatctacaatatataaatattcctacaaatcaataatttataatggacaaaagacttgaacaggcactttaccaaagaagatatctaaatggtcaataagcacatgaaatggtgcctaaaattattactcaccaggaaatgccagctaaaaccatactgagggaacattttaaaacccactggaatggttataatcaaaaaggttgacagcaccaaatattggcagggatgtaaaacaacacaaacgctcatacattcttggtgggagagagctctacaacaagtacaactacttggataattgtttgaaagtttcttctaaagcccagtatatagtgcccgactgcagtctactgcactcttaggtatttacccaacagcaatgaaaacatgtccatgaaaagacttgtacaggaaagtttatagcagccctactcataataccttcaaactagaaagaagccaggtatctttcaaccagataataaataattgtgatctattcatacagtgaactgttattgtgttagtcggtttgggctgctatataacaaagtgccatagactgggtggcttataaacaaaagaaatgtatttctcaccatttcgtaggctggaagttcgagaccagggtgtcagcatggttgggttctgatgagggccctctaccaggttgtaggctgccttctcacggtgttctcacatggcagaaagagggcaagagagctctctggggcccctttgtaagtgcactcatcccattcacaaaggctccccctccttgatctaacagctttcaaagaccccacctccaaataccatcacaatgggggttaggactttaacctaggaattttgatggggcacaaactttcagaccattaaagtgaacaagaaagaaggctgcgcttctaatacatgtcacagcagggatgagtcttagacgtgaatttcacacctggcatgaaggaagccaggcaaaaaggacgtgctctgtaattcagtatgtaagaagccccagagcagggagagaagtcagaacagtgattattatgggagggtgggggtggaattgacttgtcaggggaaatcacatacattgggaaatgagaaaatgtcttctgtcttaattggaatatatacatttgagggtatgcaccaaatgatcatgtatgtttgtcaaaagtcattgaattaggctgggcgccgtggctcacacctgtaatcccagcactttgggaggccgaggcaggtggatcacttgacatcaggagtctgagagcaatctggccaagatggggaaatcccatctctactaaaaatacaaaagctagccggatgtggtggtgtgcacctgtaattccagctactcaggaggctgcagcaggagaatcgtttgaacccaggagacggaggttgcagtgagccgagattgcgccactgcactccagcctcagcaacagagggagactccgtctcaggaaaaaaaaaaaagaaaaggcattgaactgtacatttaaaatctgtgcatttcaatgtatataaattttacttcaaggaaagaaaaaggggacatgtcttggcatgtgcctcctttcttaagcctattaattataaaactgggttacccagatcctagaatatggctatgaatagggtagctgtaagagccatagataagaatctggggacttacgggtgttgaaaactcacggtggggctgacaatgattataatctgcttttttgttaccatttcagattatgacaaagcactggtgttcatcaggaaactaatgggagtaaagggtaaatagcttagtcaaaaatgcagctctctctttcaacatattagcaggaggccattttctggttttgtgcgtcaagcacaaagacaagcatcctatttgtttttagaaatcacatctaactttctttaggaaaggaactttaattttatagcgaatgaaaaatatcaattaacctattaattaacccggagaaactattagcctgggagataataaaattgcttttgaaaagattacctgacaactgcacaaataattactcttgcaaacatccggtgttctgcctttctctctaagatacttgagagagtttaaatatcaaagaatcctgattatttcatgagtattttcttcagctgttataaaaatcatgcttcagtgtttcagggattttgttttgtgcttgtcttggcagtggggaggaggggagcttttgtgtgattccaggtaaaagtatgctactcacagccttttgtaggtcatggcttcttgagaatgtgtacaatgccacggagcctgtccccagatgcatttccatgtgactatacacatatgcacacaatcttgcatatgatttcagaagcttggtgggctgctagaattttgtctcagatcctctagagtctagatgatggaggctggatgtaagggaggagaccacccttcatactgtcttatgcccaatttctgcctccaaagaaagaagaagtaaaaactaaaaggcagaaatgaaatccacaggcagacagcctggtaccacacccggggcctggtagttaaaaatcaacccctgacctaatcggttatgttatctatagattacagacattgtgaaaatgcactgtgaaaatccctgtcctgttctgttccgttctaattaccggtgcatgcagcccccagtcacataccccctgcttgctcaattgatcacgaccctctcaagcggactcccttagagttgtgagcccttaaaagggacaggaattgctcactcgggagcttggtttttgagacgtgagtcttgctgatgctcccagccgaataaagcccttccttcttcaactcggtgtctgaggggttttgtctgtggctcgtcctgctacagatgggcagccttggttctcatttttcatgccatctcctctaatggaaacaggaatgatctccccatgtcaacacctgcagtgtgggcctgcatttgggagggcgtgtgggtgcgtgcgctggggctggctactggtgtgcattgcccagagagtttatctcagaagtctttgacaaaggcacggttggcttcattttctgtctgtgaattcaagtaggagacaaatggatttccttactttttctgatcctgtgtaggaactgtagaaaaatgggtgtttctccctagttagaaagaaatgcttttcccaaagatgaattcagacagctttatttaatggaaaaaaatgtcttgcctgtttctaaatgcattcttccctggtggcttatacctggcaaagagaaaaattagtctcttgactgaatgaagtccccgtcaagacgaaggaaaagagagaagtgagaaaagaggctagaagagccaggattgaaggcatcgtgctgggggtggggtgcgtgctgagggtaatcgttgcctggaggcacataggctagtccatcagatccaaaattccaaagcttggctgtgtaaagaacaacatctaggagtattgagaagcaatgtgggcagtgctgagattcaaaaggggcgtccctagtcccaaagacgagccccacccaagtgaatggacttcccgaaattatggtacctgtctgagcctcagtttctccatttgtggatgggaataatcacacaaagtattttgcagagcaaatgagaaaatgtttataagagtctggctgactgcgggaatgctgttatttttgagtttctcttcccttaacgatcaagaataattagagacttatagcagcctgggagaaagttatcaaagaaaggtgtactgtatctgcccaaattaacattaggatgtttcacgggagctacttatttcagaggaagagctacagatggtttggaagatgatgagctttggtgaatgctatgctctgagaatgatggaaaaacagatatgggagaaactagcaaagccgtgaagccattaaggaactgaccacctaaaagacagagtcaacaaggctgtgcaggtctcctagggagataagatggcatattagtcagggttctctagagggacagaactaataggatatatgcatatataaaagggagttaattaaggagaactgactcacaccatcacaagataaagtcccacggtgggccatctgcaagttgaggagcaaggaagccagtagtggctcagttcgagtcccaaaacctcaaaagtagggaaaccgacagtgcagccttcagtctgtggccgaaggcccaagagccactggtgtaagtctaagagttcaaaagccaaagaacttggagtctgatgtttgaggacaggaagcatccagcatgggagaaagatgaaggccggaagtctcagcaagtcggcttctcccaccttctcctgcctgccttactgccatgctggcagttgattacatccaatggtgcccacccacattgagggtgggtctacctctcccagtccactgactcaaatgttaatctcctttggcagcaccctcacagacacaccagaaacaatactttgcatccttcattccagtcaagctgacagttaatattaatcatttacagatggaaatagtgtggttcaaataagaacaagagcaccttgtgaaataacatatgtagaagccaaggcttgcaatgtacagtctagcagtggcctttcatggtagagagactcattcttgcataaaaatgaagatattcaattaacacatcctattggttgtattctataacagggtgagcacatttatttacttcagctaaattgaaaatcatggcctcacaatgtcacgtgtgtgtgtgtgtgtgtgtgtgcgcgcatgcgcacggtggtggtggttgtgatgaaatggaggaagaatatttgagataaagctaatctttgataaaattcctcctgttcagtggtgaaccaggattggagacagagaccaggggagctgccttcccaggcaaggagggcatttggtcactcaccttgtttagaactgctggctatgatacgaacacaaagcagactgacccttagtcagatctattattgttttaaattctctatagataatgtactgtcttatttctcacccctgggcagactgatcccaccaccaaccctgttctacctccaccccacactgcctctgggaatagcatatgaacaaatgtcattgttaattcctgatcagttgtggctgtgttatcaaagcaggagaatcattaggatgtatggattatggcagcttaaaaaaacaaaaactacatgagagacttagatttatgcttgcagaatgtccaaatgagttggaaaagtaagactaacaaatctagaataaaagtgaattgtctttgccaatttcactgccccatgggcagagtcaacagcaactactgtcaaaattgttcttgagatccatctgtccctagacataactataaaaaccttaactcatgggaagagtctacgtggcagctcctttgaaagctttccttgctgtttaagagaagtctagtctgccagaataaaaataaaaatttaaaaatctctactaagacaaattagaagataatgcaaggaatattgggtaaacatggaaagaagggctgcctgtaataagcagtaaaataatcttaaacattctgtgcagagtaaacgcatgtatatacaattaattccaaggccaaagggagtgagtgacatagagcgatcacatcattgtctgaggaaccattctctgccaagaaaaaaggcaacagtctcatattcttctctagattagttgactgtgaaaagaaaagagggcaacaagtcagcttcccttagagaggttgttggtgagtgggacatgtgttaatgagacacttcacaccttccctggtaggtacctggagcaggctgaaataagcaaaagtgaatgcaggtgatacaggtgtggggggtgaggggacagtcttccctacctgcaggggaaagcctgtcaagaaagcccttgcagcaagaaggtactcaaattaaataatgcttgatacatactacctacacactaaccttatggattagtatttttaaaagtctcacctttgcatcctgtttgtgagttagaaatgacttgactagacgtgatttcacatatcacgatttttaaaaatatttgcaattttctaagaatatgtatatgactaaacttatatggtataaaccatactggtaaacatgatgatgatgatgaagataatgatgattgatgatgacaatgatgataatgataatgtgctctctagaaaaaggaacaatattccagatattttaacatactgctactgaattagtccattctcacactgtgataactacctgagactggataatttatgaagaaaagaggtttaattgagtcacagatccacaggcttaacaggaagcatggccagggggccttaggaaacacaattatggtgggaggtaaaggggaagcaactgtgtcttcacatggtggcaggtgagagggagagcgagagagagcaagcgcaaagcaggaggtgctgcaaactttaaagcaaccaggtctcatgaaaactcactatcacaagaacggcaagaaggaagtctgtcttgatgattcagtcacctcccgccgggcccctcttctaacgcatagggattacaatttgatgaaatttgggtggggacacacagccaaactgtatcaaccacatttatttatcacagcagctattattatccctgttctatatagatgaagaaatgggggtttaacaaattgcccaagatgatagagctttgcccaatctatccatgtaccatcaaggccatagctttgcccttattttgcttgaagttgaaaatttcttttatattgttgtttgattttgttgtattacaaagccaaatctaaagaatttcactgtaataatatgcatagtaggtgtaattagaggtaggcttactttgtttatttatagatttagtttgcaatttaaaatccatgaagtgatagcatgtgtcatagcccatcatgaatttcgaatgaaaacactgtggctgtactgagcttctgagaaaaatccaagcgggtaagcaggagttctgagatggagatgcacaatcttaattacattagctgcctccttgggctattttgtgtatgtagtggggtgggcagtgggcttggttcttaatgtaatgagtgatttcaccaaggagggagacagggcttgacttgatgtgtatgggtagtaagtggattactagaagacttaagaacagggaggttagaggaaattgtcacattttcactgggttaggaattttaaaacaaaaatacgagcttcaatgagagaaggaacatacatggcctattttaatgatcatgagagcaagagactgtctgaagtaaggttcaattgcaagattcaaaggtaggacaatgagcatgttgaaagctaaggagaggaataagtgtaggaggaatacattattagggaaaaggaaacgcaaattgtatttcctttgcaatttgcaaaggaaaatttgcaaattttccttttgcaaaactaaagagaattgcaaaacgaaagaaaaggagagtgatgaagagaaccacatgggcaaaaaaataaagatgtagacaattctggatgatgttaacaaatgaataaaggcatgtgccagcagtttgcttagggcagctagtctattcagacagagagttacagggtccgtccgaggggtggaggcacaggcggctgtggtggaggggtgctggggctgaggtccagtgagctgcctgcctctgtgtcaagaaagaagaactgaaggtcacattctggaaacagaaatccactttcctaggggcagtgtgaaatgttaaaaggttttatgttatgccagagaggatagttagacaattagagttatctgaaggttgacaaggcagcaggcttagatgaattacactccagcagtgtggagaggaagcgccagtgaaatgtgaaatttggagaggctgagccactcccagcactgggggaaaggaggtggctctttgaattctgcggtgcgggaatggcagagcacacctggaagccaggagggagcaggtgttacccttgaaccaggcagacgtgggggaggcccaggcgtctcatctctcccctcctcctgccctgtgggaagagcatagtccccctctgcctttttctttccttttgtcttcagtccgccctccctgactagtacatggtcggtcaatcctgtcatagaacagaaactagatgtttccagaatttttatgccacagcgcttgaatgttctattgtttcacaatgctttgacacttagaagacaatactacatagtagacacttaaaataataggaaaaattgtctgtcaaataaatgacttagaagacctggttactatgtccaataaatacttggtgttttattttactcacccctcttaacttctccttgtttcaacacctataaaataagaagagtaatatctgcgctctttaccagttttcctgaagaccacatgagataaatatgtgaaaacacactatgaaaagcacaaaatgctttataacctatagcattatttttgtaagaatgaagcaaaactgtaattgtgtctgaaatctaagaatggatagagggaagatatattccactgtagactcgaacatgatttgattaaagtctgactataagaggagaaaccacttcctgatgaattatgagacccaatttaaggaataaattattggattggcttttaaaaaagtccagtagtggccgtaatttatcttgattagtggaaaggtttcataaactacagtgtgcaaaatattgatccatttagtaagtacaccatgcaggggcccctgcagaaggcaggcacctccagctctgcagagggcagcacagtggcccactgccttttatcacagctgtggaaccaaatggaaactggacgccgtcacggaaaacgatcagtctgcatgacgggcgcatggaaaggaagcctgacatttgaaaacacgtttcttccaaatatctttaaagatttctgaaccagagctcacccacctatctgtagcctccaaattatgaacagaatcatgacagaatttgggtttgtttcccagtggctctgccttcttttgttcttaaatattttttccaaactctcagatcataaccaaataacaaaggaagcagctgtgatgctcctacactgtggtaagtcccctttgagaatcgtcattgtggaaaggagagaaacttagattcttgattctcagtaggtcgttcttgatgaacacttgctaaccccaaggcattcatttactggagcaaggttttgtgcatttcagatgtcagcctgagattctggtaagatgttaggaagtgctccagctgggaattgccaccatagttccttctcagcctcactttagagaggtcaagtgcatctagaaaatgccaggctttagagtgacagcatgaaatacccccttgggttcttttttctttttctttttcttcttcttctttttttttttttttggagacagtgtgtcactctgttgcctgggttggaaagcagtggtgtgatcatagctcactgcagcctcaatctcctggactcaaacgatcctcccacctcagcctcctgagtagcatgtgccactatgcccagttaatttttaaaaacatttttttgtagagatgagttcttgctatgttgcccaggctggtctcgtgctcctgcccaaaagggatcttcctgcttgggttctttagcagaattccagaggctattcctacctgttgtaatgaaacttctcgatttgctctcctctccaaccacaccctccccatcagcatcttctcatctgccctctggggatgtggattcccttcggcctatgaaggcaggtctcccatttaggatattcaaaagcggtctggtgcgggtggctcatacctgtaatcccagcactttgggaggctgaggcaggtggatcacctgaggtcaggagttcaagaccagcctggctaacatggcaaaactccatctctactaaaaaatacaaaaaaattagtggttgtggtggcatgtacctgtaatcccagctacttggtaggctgaggcagaagaattttctgaacctgggaggcagagattgcagtgagccaagatggcgccactgcactccagcctgggcaacaagagtgaaaactccatttcaaaaataaacaaataaataaataataaacagaatatgcaaattcaactccaaacccaaatgaggaaggccatcaaataagatagaaggtaatggttcccactatttgagtaagacagccacatggggacaaatggcttgtgcaatttagtggagtaaatggcacggccacatgaccttgtttggcttctgttggttagcagagatccttggcatcagccagatccatttgttttcttgaatcttagcttttcctctcctttgtccccaaatatcaaagggcaaaccacttgacatcatttctagctgtcatttcccaatgcagtagttttaaagcctgaaaagccaaaggcaccactagaaattacatatattgtggggcaacacgtggaacttaaagaaagtgagcatgaggaggagaggagagatgaggcgaggcgaggggaggggaggcgaggggaggggaggggaggagaggatgaattgctgccaggtgctgccccacttttcatacctatccaagtgactcttccagattctaagtacattcagattgtgttttagtgaaatgcagtaaaacaaacagatgttaaattgctttcatacatatcttgttttatccccataacaattcagtttctggctttatcatacctgtttgagagatgaaaaaacaagactcagtgagatttatgctccccaccaaaaatcacagcaaattcaccacagaacctgaacagtaactgagatcccgtggaaggagagcagaccagggaggctgacgttgttataggagtgtgtgcattttacctattagttcaaggggttttgttggtgttttatcatgctccacaaccaatagcaaaagcaacaaataaatggtataggacagtgcaaaggaataggatcatacccaagtgcgttttaacaaaataagtaaacaatcagtaaaatgtatctgggagtgctggctccctcagggcccctggaacaggggtgcatagttaagaaatatacagagttctgctctaagaaaacgtgtattccttaaaaaccaccacattatacaaaatcacaccaataaaaacacaacagtaatgagagaaatggggttatggacacaacatttaaatatgttgtcagtgaaaaataaaaggaacatagtaaaaatcggtagcatagtttcacacaagttatatggttaagaaatacattgaaactacaagatatatggcacttcaccttgaaaaaagccccagagttcactcggaggagtaagagctgaaaaggctatagttgtgagtgtttgggaagaggtagaagcaaaggtgttgaaatcggacggaagtaacaccagacatggatgcgtgtggcctgtcacacgcggagaacccaggcagtggcagcttgatggtgtgcagccatgtgttttatgaatttctacagactcaattcctgggctgcaagcagtttttctgcattcacttagtgcttctcccagaccaaatcacacatatgcgaacaggaaattaacctgatgctcaaattgttctctaatctatcaattacattgaaacaaagtcacattttcaaagcaagcattttaacagaagtgactgcacctaggtcctccctctacggagcttacagtctccttcagaataaaatatggacaaataggaaatactggattcgtaagtgccaaactaatatgcaggtgttttggaaagggaggggccgctggggcagtcaaagaagtttgttgcaagaggcaattccggaagaaatgacctaagcaaagtcagagaagtggaggtaattgtgatgggagaaaagagaggaagaggtagaggacagagaggacagctgctcaggggtgaatgagaaacaggtttgagcagaagctgggctggctgtgataaatactgaggaatgtcactggaatgtcactgcaaaggaggtgttttttaatgtttgggtgtaaatcaagtctgtagcacagactgagggaatgaatattttacagaattgctgtcatcgttctgtatcttacagcccattctgttcatttctcattcaataatatttattgagtttctgttgtatgccaaacgcgttcacaactgtggattcagctgtgaacacaacgggtgaagcatctaccgtaaggagtggacatcctagcagagcaggcacgtggctgctggttaaggagacgggcacccagtgagctcaaaaagcagccagggctgcggcatgaggcagaatcaggagtcagggaaggatgagccgtggaggaagatggctgtctcagagagggtggccagagaggtcctctctagagaattgacatgtgaatcccgaggtgcccaaaaggagtgggagcaggtctcaaaaagttggtcccaggcaggggaagcaatggatggaaaaatctgacatgtggagaggcagccacaagtctgtggggtgggagcggtaggagaggatgtgggctggagtccatgggtaggagttggggctttatcctcagttccgtggaaagctgccaggtcatgttgagcaggagtgtgttgtgatcggattcactttttaaaaaattattttatttccataggttattggggaacaggtagtggttggttacacaagtaagttctttagtggttattcgtgggattttggtgcacctatcgcccaagcagtatacactgcactcaatttatagtcttttattcctcacccctttccactctttcctcctgagtccccaaagtccgttgtgccattgtgtcattcttatgcctttgcatcctcatagcttagctcccatttatgagtgagaacatatgatggttagttttccattcctgagttacttcatctagaataatagtctccaatctcacctaggttgctacaaatgccattaattcattccttttttatggctgagtagtattccttcgtatatatatataatacatatatatgtataatatatattatatatattatgtatatataaaatacatatatatgtataatatatatattatatatattcttgcaattgtgaattgtgctgctataaacatgtgtgtgcaggtatctttttcatataattacttattttcttcttggtaaatacctagtagtgggattgctagatcaaatggtagttcttttggtgtattttgttgtttgtttgtttgtttagatggagtctcactctgttgcccaggctggagtgcaatggtgtgatctcagctcaccgtaatctccgcctcctgggttcaagtgattctcctgcctcagcctcccaagtagttggaactgcaggcacatgccaccacgcctgggtaatttttgtatttttagtagagacagggtttcaccgtattggccaggctggtcttgaactcctgaccttgtgttccgcctgcctcagcctcccaaagtgctgggattacaggcatgagctgccacgcccagccaattcttttagttttttaaggaatctccacactgttttccatagtggttgcactagtttacattttcaccagcagtgtagaagtattcccagttcactgcatgcacgccaacatttatttgctgggataattggcaagctacatgtaggagaacgaaactggatcctcatctctcaccttatacagaaatcaattcaagatggatcaaggacttaagtctaagacctgaaactataaaaattctagaagataacatcataaaaacccttctagacattggcttaggcaagaatttcatgactaagaacccaaaagtaagtgcaataaaaacaaagattaatagctgggacttaattaaactaaagagcttttgcggggcaaaaggtaaggtcagcagaataaacagaaaacccacagagtgggggaaaatcttcacaatctatacatctgacagaggactaatatccagactctacaatgaactcaaacaaattagcaagaaaaaaacaaacaatcccatcgaaaagtgagctaaggacatgaatagacaattcccaaaagaagatatacaaatggccaacaaacatatgaaaaaatgctcaacatcattaatgatcagggaaatgcaaatcaaaactacaatgagataccatcttactcctgcaagaatgattcacattttttaaaagataattttgcttatacttggagaagctctaggggaaaaaactggaaacacaaagaggaggtatgggagagttgatggtggcttggacctgggtggtggatgtaagcagggaaggaaggaaggaagggagggagagagggagagagggagagagggaggaaggagaaagaagagagctggattcagtgttttgaagttaaagcccacagggtgcactaatagactgctcgtgaaatatgaaggaaagtgaaaattgaggataacttcagctctgcccccttccccagaactgagtagatggagatctaatttactgcgatgtggatgactgggagggcggagtgttgtgtggactccccaccccagattcatatgttgaagagctaattggttgtgaggacctcagaatgtgactgtctctgcaaatcgggcctttaaagaggtaattaggttaaaatgaggccatagaggtggaacttactctaatatgactggtgtccttatgagaagagaacatttggacccacagtgagacaccaggaatgcactgccacagagaaaagatcatgtgaggacacagtgagaaggtgccgtctgcaagccagggagagaggcctcagaggaatccagcccagccggctccttgatctcgggctttcggcctccagaactgtgagaaaataaactcctgttacttaagccactaagtttgtggaaagagagaactcaagggggctttattttaaatatgttagaaagtgtcaaatgaagttcaaaaaaaaaaaaaaaaagactagagactctaggttaagcttacataagagacccaaggacagcaaatcattttgttggggataaaagtgatatttgtaggcaataatgcagcttctctgattttgtactaaatacgttttagtaatttttttgtggcccagctgaggatagcttctcgagatacccttatggtttaactgtatttttcacgcactgttactggctaaggtcagtggatcaaagagacacagtagtctatgcacgtttccgatttattaggttacgacagtggggaaactttctccttagtctagtccatgaatctgctcaccaatgaaaaggaaatatagctaggaattatagcgttactgactccgtaatacttcaataaaatctgttcccagtttgagaaggagtcgggcaaacacaggaacttgcttaaggaaaataaccatgatatagataaccaacagaaagtctagagtaagaaacctaccccactccctttctagcagtgattgcctattacaggagaaaacagattggaagaacaaaggggaaagactcaacagaaactgtaatgtgacatagcttagtctcctgaaaggagcaaagaaaatcagctcaggagtaaatcaggatctctcttctcttgccaggacaaattcttcacttttaagatcaagattagggagctgattagaacaggttagcttctgtttatatatgagcagtttttaattccatagccattttagaagaaaaatctgagtaatcatcgcctcaatgacagaagctagatcaacctcccacaagctgcagctttagaatattggatggaaggaaattgatcctgagatgtggaatcccacaatattttcactaacaggtttccatgagaagtgggtgcttcattcattcttgtctacacacctatttctgcacttcctcctacaatatctcttttgagccagcctcagaccaaacacgactgcattccaaacagtcctctgttatgttctttttattattattattattattatttttgagacaaagtctcactctgtcacccaggctggagtgcaatggcacgatctcggctccctgcaagctctgcaacctaccaggttcaagtgattctcctgcctcagcctcctgagtagctgggattacaggtgcccactaccacacacggctaatttttgtatttttagtagatatgaggtttcgccatgtttgccaggctggtcttgaactcccgacctcaggtaatccacctgcctcagtctcccaaagtgctgaaattataggcgtgagccactgcacccaaccttgttatgttcttttcttggaggtctgtgggaactggtatgaaggtggtacactataaagaaaataacttacatggccaactagagttctgaaaaaccctcttctttaacacaattaaagctcattaaggttatgttgtgctgcaaagtggccttttcaaagagtgtgagaggtgcattttattcacatatatttgcactgagttcaagtatccctaattctcattatgtgtaatgcatttactgtgaaaagacatagaatattgaaaccacaacatgacatgcatacaattcataacaaagctttcaagctatgaaatatttcatggtaggacagagaagcacactccgagttctttgtagtagagttatttggtgtcacataacgattaagaacaatggctccagtcacaaaggcttgagtttaatccttgctcaacttttaattggctgttactttggacaattactctctcttaagcctatttccacttgaaaaaaatgggtaataacaatgtctgtcttgtaggattactgtaaagatgaaaattgtattatcaaaagctgagtatagtgcttggtatagagtgaagagggcccgcattggtatctgtgatgatgatggtggtgatggtgatgatgatgttaatgatgttaatgatgatagtgataatgatggtgatcctgatgatggtgttgatgatgatggtgataatggtgatgataatgatagtgatagtgacaatggtgttaatgatgttaatgatgatagtgataatgatgatgatcctgatgatggtgttgatgctggtgataatggtgttgataatgatagtgatagtgatgatggtgttaatgatgatagtgataatgatggtgatcctgatgatggtgataatggtgatgataatgatagtgatagtgatgatggtgttaatgatgttaatgatgatagtgataatgatggtgatcctgatgatggtgttgatgatgatggtgataatggtgatgataatgatagtgatagtgatgatggtgttaatggtgatggtgataatgatggtgatcatgatggtgttaatggtgatgatgatggtgatgatgatggtgatgataatgatagtgatagtgatgatggtgttaatggtgatggtgataatgatggtgatggtgataatgatggtgatgataatgatagtgatagtgatgatggtgttaatggtgatgatgataatgatggtgacagtgatgatgttgatggtgttaatggcgatgatgatgatggtcataatgatgatgatggtgatgcttctgatgctgataatgttaaactgaaccaagtctctctgaaatgaaatgtggtgcagccttcttagatcattgggcaaaaagaaggcctctcaggacatgtttctgctgtagcttgtgccactcaagtccttgggatgctttgtaataagaaatgaaagttagctgaatgtattttacagaaatgcaccgtttaatactcccttacataatgcaggatcaggagatatagaagtagacaatcatgttgtaacttttaataaattgttcaatcatagtattcaatgctgctgcaccattgattgtattagcaagcatcaaaaaaatccttaaatgataatgtagccgacttacacaaaataaacttaagattactgttttggtcaaagaattttcttgggtcagtagagggagatgaggaaaagaaaaatattttattatattgtagtatattaaataggttttattgtatttctttttaaaaaaatatacaagtgagtattctctcaaaccttagactttttcaccctggcctttcattgttacttgactggctgttactttggtcctatttttaactagcaaaagatcagacaaaataaagggaagaaaagacaattatctaaaaatgcaacatgtacaactgcacagtctagaaataacttgggtgtccacatgtgaggtaagcatctggaactagcaaaccatggtgagacattgtagactcatccccctcccattatggacttgacctcccatcccatgctcctggagatctggtctatgatgagatttctctcatatctctatgagagatactgttgtcgtttccttctgagtatctataggtgattaactaaaccgatcagactgggaactcctccagtgctacactgtgtacactggttgaataaatgaatgaacatataaaagaacaaatgaaaccatatcaggggtgtcctcaatttggggagatgcttgaaatcaatctgtcttatgaaggaactaggaagggttacagtcttattcaccaagatctggcgcaggctttgaaagaagggacacctgacctcaggtgatccgccagccttggcctcccaaagtgaccccatctctactaaaaatacaaaaattagctgggtgtggtggtgcacacctgtaatcccagctactcgggaagctgaggcatgagaatcacttgaacctgggaggcagaggttgcagtgagtggagattaagccattgcactccagcctgggtgacagagcgagattctgtcccaaataaaggacaaagaagaatatttgttcattctgtacacttggccagagatgtttttgactgaaattcattggttaactaacagtgcttactgggttttatcacataagttcatataaatcaatcaatatgattacatatctgttcaatgaaatgattccaccagaggttctcaaagtgtatctgaggaccctgggggtacccagcacctttcttaggacatctagaaagtcaaaactattttcataatgatatcaagatgttatttgccttttgtactttcattctctcatgagtatgaaaaattaatcaatttggtttcagagtgcacattacaactaaccttgtcaggttttgatatagtatcaaataaaaatattcgcagttatctgataaagcaattaaaacatcctccttttccaactacatatttttgtgagactagatttcttttatatacttaaaccaagagtaatatattgcaacaaattgaaagcaaaagcagatgttggaatctggctgttttctattgttttccttcttctattaaagtcaaggttactaagatttgtagaaatctaaaacaatgccactctgctcaccaaatttttttgaaaataattttgcataaaatgtgctgattatagtaagatataatagattttcattttgaatacttaaatattcaacattttttcattttattattgtaaatatacaataattcacaataatatattacaatatataatatatatttacaataaaattatatatttactgtaacaaattatatatatatttatcccttatatatattttatatatatcccttatacacatatacatatacatgcacatacatatataatgtgtgtatatatttatctcttataaacacatacacatgtgtacacacacacatatatgcacacatacttatatatgcgtgtacatatttatcccttataaacacatatacacacatgtacacacacatatgtgcacatacatatatatgtgcatgtatatatcccttacatatacacacatatacatgcacacatatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatatatgtgtgtgtatatatttatcccttataaacacatatacacacgtatatgcacacatacatatttatgtgtgtgtatatatttatcccttataaacacatatacacacgtatatgcgcacatacatatttatgtgcatgtatatatttatcccttacgaacaaaagctctttggggtcctcaatagcttctaaaggtgcaaagggtttctgagaccaacatgtctgaaagccactgaattaccttaacagctcctaggtctgaaagtttatggttctaaaaaatgcccagcacttgctgtttctatgaggaataaaagtgattgtctcaccatcaacactgtctacaacactgttagggagacaaagcttatctacatcaacatgatggattagctacttttcttagttctttctagctcccacaacaaaataccgtaaactgggtggcttataaacaagagaaatgtattgctcacggttctggaacttggaagtccaagatcaaagtggaaacagattcagcatctggtgagggcccgttcctcattgacagtcatcttgctgtattctcatatggtggatgggactagaggtctccctctgggatttcctttataagggcattaatcctattcaggaggtaacattcatgacctaaccccttccggaggccttgcctcctaacaccatcacattgaaggttaggattctgacatagggattttggatggatgcatgcattcagaccacagtgacagcctacaatcaagttctaaattgtgtagttcaaactaggagaactgtgaggagatggttttggggaaagtgacttctgcatttgcctcaatgattttccctgcgatgacacgtggcctgctctgaacagtgtttgttccacaaaatgctgctgtcctttattcagaaactttctattgaaaccaatttttatctcaataacctgatttttaatctcacaaaactggacctggtgactttgaattactatattagaaccttgtaaattgccttgtttactgattgttttaacacaagatcctgtcatctcactagactatgtaaatttgcagataaaaatgcccatcttagattggtcagcctgggggtgaaaatggactcaaccacttctatctattgattaaaggactctgagtaagtctcctaagtatatgtttttttttcaatctgtaatatcaggatgttagctgtcatttttaagcccctgtgatatcccatgtgatccaaaagacactttgtataattcatcaattctcaaaacaacatgctgagataacgtaattttcattctctataaatggggaaaccgaagatcaaagaattgaatcatggctaaaaccacacaactggtaagtggaaaggagttccacttaaattgaacttataactttgatctaagctgtctgattctaaagctagtgattattttcctattattttgatggtcagctcttaagagttcttgcaatagttgaataaagtgaagcctgtgatagcctagtgcgatgtcaggtacgtagtcagtggtcactcagccttggttccccttgtcctgcccttctcctgggccacagtgctttgtagagctgtattgtaccatcccagtaggtttagccacacagagcccatgagaacaagctttgcacttagatatgctgtccatgtatttgacaattgatttgctgtcctgactttgctattacctatcctcctgatcatggacaagttcctccgcttctctgggctttggctttcttttctgtaaaaggatgaatttggacaagattaccatcagatctatagattttctaccttatagatctgtactattgctgagatttttgtgacaagcttaggagttccccaaaataatgaaactgtgctatttgaacattttctctgaatctcagaggtacaaatttggaaatctacattgtcattaaggaaatgtgatgtataagaaaaacagtaaagtatagctgccgtataccgtacttcttaggtataaaattcatgctataaaatgactttcttcatctggtgtcaaaccctaaataatgggaaataatgcaaaggaaatatgtttcctgatagtcaatagaaggaatgacggacccagcagccatgtgagggtatatttaaactaagaccttcatttcatgcttctcatgattctaattctcattttcccatcgagttaaagggggaggattgagtttaacatgtgggaagagtaagatgccttggttcttccattgttagttttccatattcaccatgttgtataatcattaagcgtatttaatcgtggttattgagttaaaaatgaagtgttaccacccggttttgcagcatgtgccgtaattgttaatctggttatgccaggttgctatgcataaacaatgtctcacatcaatttagaaaatatgatcattactgtttatgaactgataatatagaaaaaaccatttagaatggatagaaggaaaatatcatttttctaaagaaaagcaaaagaaaacatgtcgttggcagagtaacaacatgaatcatagaatctagaagctcgtaagggtctgagaaaccatgggctccagctcaccaagtaccagaatgtgaagtgatgtgtccaggtgccatgtcccccagaggatgctcaggtctaaggctgaaatggccaatctgttcagaagcacatgggtctcctttcctaataaaggaagtagctaagatccacccttaaggcggcaaagtgtgtactaaggcatcaaaaggacaagtcaggtagtgagtaggtcacttattaccagactcaataccagtagctcctgcagaacaggggatgacttttcctctgaaaacaagagtacaagtgcctggtctctgggtgtgcctatggggaaattctgccctggttctggggctcagtctgattccaaagcacacagtcctaagaatggggctttccacgcctcagcccctgtgtcttcccccttcacctcctacaacactgccccagtccgtgtgggtcaactctcctttttctcaaaagccttcacttctaaaagcaaggttgtttattaagttaagtgacaaagagatactgcaacaataataagctgtgatcaaagactgggttgatgttccacatcacaagcactttcattggaagtttctaggattccaggatgtctgtttctgtgaatcccactcagaagactgtgtcttcattaatcagagagaagacaatgcaaaattttaagctctggtaatagtctatgtaaactgactattgtccatttattttgtctctactgagtttaaagattcagtgataccccatttatgtgtcgatccaatcagacaggtaccagaggtgtctctctctggggtagcaaactcagaggggacaaaaatgacagctctactattggttgtggttgcgaacacatatattgttgcaaagaggaagagcctattgaaatcagacgtgggcaggtgttgagttctactgtgatttgctattttccatcatacagagcaaggacaaccagaactgcaaagacagaggccagcagtggtaatgaggactgaagagaagtcccagcatggacaggaggcccttatcatttttaaacagcacaattccctccatcttacctttggcactggagataaatgaaataggctgttctgtttgaaaagagtgtacctgctcagtgggaccagcaagcaccatgtggccatactgtgacagtcatcaaaagaaagagtgcaccttcctttgcagtgataagggggtcacagagaaagcctgggggtcaaagctagatacaaggcatcaggctgccactctcatccagggacacaaacattcttgtctccaatattggatctgaaagtaaaatcaacatattctgaaggaaaaggatccagtgaaggaggacagtattattcagggaggccttgctatacctttatctccggggtttcctgccttacaggaagatgttgccttatagaaagatttatgaatgagatgctttgatgaaagtctgtaaccaaaactcttagctatgtggatggataactatagccagcttcctggtttcaaggaaaaagttctcaaaactctctctacattttgcatcctgaaataatcaatgtatctacctccctggatagacaattagcttcttgagaacaagtaccctgaattgttcactttcaattccctggctgccagcacagtgccttgaactgaactgagcttctacctaagcatctgtatcttctgctaaaagagacctgcctgctccatccatttttaacaggactctttcctaatatttgcttttaattaaatggaatattcatcaaagtgaaaaacatgcttcacttagtacattacctcagactacagagaacacacctctgttacttcttatggtccttttgggacagctgtggatttagtttcatagactttattagcataattgaaaaagacaatccgaggggaagcattttgtgcaccgcctggatggaaattatatgaaggtggcattaccagtactgtacttgctactaaaatttcacctaaagactcattgcaaagcacttgggcaaattttccttttctcacttggaattcaattttgaaaattgggggatgtcaagaatttcactgaatgaggttcatttttaaaatcccattatgagagggcagtgtagggggactccattagccccaggagtgttgaggggaaacgtaaatgagtgaggccattaaagtccttagaccacgggggcctcaatagagcctgagatggctgctgaggaggtggagacatggtcatgataaggactgactcccagcccagaggatgatgagctggtgcgtgttctcatgctgtgtcaaacctccttgcatatcaatcttctgttcaccctcacagccaatcctgaaatccatcctgtctccacatctgtggagtttcctgttgcatggagctcctcacaaaagtctactttccaagacagctttccccaacccagaatgacagtgggattcacacattatcaagaaaagtcacccatttcattttgttcccactggagtctcttttatcacttccctcacaaatgattctggggatatttaaactaattttctagtgtagaagaatttaatggatgtgtggacaccatgaatacagctgctgctcagtgcctgtacttgcttttgtccccaggaattgatttgagtgcaatcaatttgcaattcccaataatgtagagagctgcctctttgtctcagcatctgtcctgctaactgtgaggcccgacactatggtgaaggaggcagaataggaaaggaagagcttctggcatgagagacagaaaaagcttcagatggaggatcaggaccacaggcacacatcccctaaagatcatggaaataatgacaaaatacaacctgcgttacagccagctcccctagcaaggtgtttattctgtgcaacaagacacgcttactctcaccattaggatcatcattagctttaaaattgtcaagtgacaattacccatatattgcggtgatacactttttatactgaagcaaaatacagtcttatggatgggttattttctgtgtaacaatgcacatcattctgcaagatgaccaaacaggagagaaaacaattcacgttctgtagattacttgattgtgccccattttgttaatgggcagtatattttaaactacaatttcaaagtcaaatgtctgcattggttgtttctttaagtgtaaagagatcagaaaaaaagggtttattccttagaatgagtttccctgagatgtagcgaggacattatagtcagactggcacaagcaaagaaacagttacagcagcaccaacaattaggagaaaaattggactccaagtgaaacaatgctaggcgtctcactataaatgctatcaacactttgtgtgagacaggtgcagagtgtgaaagcaatcattcgtacagataatcactgtatcaaatgcgtgtccctgcctggactgcacctgccacaccttttcataaagccaggaagccagacaacagtgtcttgttgagggttggctgtaccatatgggaactgtgagccctgcaccagcatcaggtggtgcttctgttatttgctctctcactgatttagaggagtcctgagaaattgaggtcctcaacagaaaacacatgggtcagtgttaattcatctccagtgacctttgctgctgtggaattctgtagtcctgtctctgttccttcttttatccaaggcttctcattgcaaaatggaaaccgtattgtcaggttctaagttctgagcagcattttgattgggattctatagttcctcagtcatatcactattcttatcatggtgataccaatacaattattacaaatgcaaatacaacccccagttttcctgcaatagaatatgtgagccatttcacactggagttgatctacataaagtcagctgattctaagagctcagatccatacacccgcccctgcctgtcaacatggccactgaccacgctaacacgctgacgaggtgagtccttcacctcttggcaaccagaagtgttagaccttgaattttagcatttgctgaatggagatgcttccatgcactttagaagatttgattcttctgcaagaagaattctcctgttaaatatgcaaaatacgttttttttcttgttctttggcactagttaccaaaatctgcaagtctgtctatttttaatgtaccttcttttaaaagcactgcagtgcctatgtgtatattaggctctaaacctggctctgggaggtcatgagtataattttagacctagcaagttctgaagtcactgtttctcttgtatttcacaatgaaatgtcaggaataattttttgaaaatgaagtggaaccttcttttaaatacgagcccttcatctccatcactcctcccaggctctgtcataatcacaggccgggagctacatttctggctgatgggatccttgtgcagttggcacaggctctgcccccatgcctctggaccctcagctgtccttgcacacctgctgcaggtgcactgtcatgctcagggcagcacctgtgtcctttcattggcacttccggcacgctgccagagctcttactgcccgcctggcctggtggctggaaatgcctggggattttgcccctttgggcagcctcagccaaggactgccagatgtggggaaatatattccagcctcctttccccagcagcagctctgaaggatggcctacctgctcctagagtcctctgcagggctgaggcacagttctacctgtgtgacctccttccctctgtgtcccctccccatgggtttcccttgaaacacatcttataaaatcacttacctagaatacacatttaagcctccttctcataacccaacaccttggcccaaagagcggaacaaagagccggaaccctggggagttgtagcctatggacaccaggtctcggggcctctcctttaaggatatctcttttttccaaacagagtttaaagatgtccttgttccaaattgagaagacaaaaagcaaactatgttgcaggttttccaaatgatttcagaccagatttacaatggcttgctctttaaaaattgaagaaattcacccctggtatgccaggagcctgggagtctgcaccaggattgtcccctgcagatgtgaggacagtttaatcagctccctcctcagtgctccatactctgtgagacgttgtggggaaggcagcatttaaatctacaaataaaagtactggatccctcaagaggaggagagagtggtacaaccttaatggccttaaaggccaagaacttaatggccaagaagccagacatggagatatccatggccattctcaccccactctttccttcccactgcaccagcccctccggctccaaatcaaatagctctgaattcagaatgcaatttgaaaacttgggaatcaaggctcttctctgtggatcttgtatttgagatagtaagaccttgccagtgccttgaagttatctatttaacctagcatagccgtcactttggaagagtgaggccagcactccaggctacgctgtgcatgagaatgaggacaattttgctaaaacaatacaatgcttctttactgagggtgggtctattttgttttaagcttatggatattatcttacaaatacctgttaaaaccccatgcgtagttaataatcccattttagaaaaaaagccactttgacattgaattgctaactgatttttcccaaggtcaccccagtaaaagtgtcagattctgaaatcagattctgtgctacttgatgttaatgccccgtaggcctctcaatcataaaatgccttagagtcacagtgggtgtgacatacgtgaagttgaggaaagaacatttcccttttgacagccagaatagaatcgtttagcaaatggcattgataaggtcaataattcaaatgggaaattagagtattattctgacctcacaatagaattgattaggaaatggcaatgataaggtcaagaatgcaaatgggaaattaagagtgttattctgacctctagggtagagaatgggacctctgctcagctttaagtgaggagcaagacagaatagtgatggtgagccctggagatgcagtcagttcttgctgttcacagtagtcatgctctataaggttgccacaaaggcagaattaactaatactgagctgttgctcctagtggaaatgtaaggttaggttccttcaagcctcgggtcacaacattttcatccacagatccacacataagtttcttaagtgagcatttctgtttaaaaacattgtattacatatatagtcttcattcattaacactgatttcatggccaacggtactataacacatgcctgcatgaagcttttccaacacacatattcttctccataaggcacatcacggtattcttgtgcttgggaaccctacacagcacttcagcacgcacttgggggccattttaaacagcaaaatcaccaacaaaaaatacaaaaatgtggaactaaatagaccatgaagaggacacttgtttatagtatgagctaaagcaagaaggcagagtgccgtcatgttcagacccagctaggaacatgtgtgtcaggcaactcacttttttttccactgtgtacatgactgcaaaagacctggaaagcaccatgagtattgatttgcaagttacacataaattttaggagtaggtcgatctgcaaatattgcatccatgaataataaggatcacctctgttagcattagcacattgcccattgacaaatctactggattcatctgagctagtaaaaacaacaacaacaaaaaaaacaattgtcaatcagaccaaaggtaatctccattcgtacacaaatagaaggaacaattagcttgggaagatctgcctgtttatttaattaaaaataaattttaaaagatggaaggctgggcatggaggctcacgcctgtaatcccagcactttgggaggctgaggtgggcagatcacttcaggtcaggagttcgagaccagcctggccaacatggtgaaaccccatctctactaaaaatacaaaagattagccaggcatggtggctcatgcctgcaatcccagctacttgggaggctgaggcaggagaattgcttgagcctgggaggcagaggttgcagtgagccaggatcacagcactgtgctctaacttgggccatagggtgagattctgtctccaaaaataaaaaactaaaagaaggagaagaggaaagtagtcttctctctcttgctccagcagttctgaatcacctttgtgtagtttcttgatgttcttgcttttcctgtgcaaatgggtagtgaccttaacagtgcatactgtgctgaaactctccccagtgagagttcttccacatattctgagccatgctgaataatcaggcaggtgcacggctttgcccacactcaagtgaggaaggaccatgggactcttcccgtcatgcgggcgacagatgtggttcagccactgcaaaataaaaagccaggccctctgtataacgaaattcagtgaccactttgtttcattaagaggcagtctgttctgtggacctgggagggagagacagggagcgtttttcaccaacaacttacaactccacagtaagttgagaggagtcccgactccatgctgtatgaagtccagcactgacacaccatggccagcgaccaacttgctaagtcaaaaaaatctaactcagaaccctttgactgaggaacagttttcacactccagaaaattctaaatgactttcatttgctgttggttcacatgccctcgtggaagactttgcttgctgctttgttttcataagcagcttgaaggaaactcaggcaggaactatggaactccagctgctgctgtaactgcatcttgacgatgcaaaatgacgatggaaatatagaagcatgtacatcatatctatcatgaattgagcatgtgggtctgttccctcgaatgaaaaatacatgcaaataaaaatatttggctataggtggtgcaacttttaacagttgttctagaacttacacatccaaatatgtgttttcactttgcacagggtggcctatggagttttatgcttgctctagtaatgttgtagtggaaaacattttggaagtattttaatgtattaaccacattgtttaatatctttaacctcattaaatcacagtcctttaaggaatgatatgtgtgcactcttgtatgtgtatgagtgtatgtatgtgtgtgtgcagttgcatgtgtgggagtggggatgcacgtgtgtgtttggtgtgtgtatatgagcatgtgtgagtatgtgtgtatatgtgtgtgcaattgcatgtgtatgtatgtgtatgtatgtgtgtttgttgtgtggtatgtatatgggcatgtgtgtgtatatatgtgtgtgtgcagttgatgtgtttgggggatacctgtgcttgttgtgtggtatgtgtatgtatgggcatgtgtgtgtatatatgtgtgtgtgcagctgatgtgtgtgtggggatgcatgtgtgtgcattgtgtatatgtgtctgggcatgtgtgtgtatctatgtgtgtgtgcagtttggggatgcatgtgtggtgtgcatatgtatatggacatgtgtgagtatgtgagtatatggtgtatgcataattgtgtgcatatatgtgtgtgtggcatgcatgtgaggcacgtgggggtttgtgtgtgtatgaagaacaaatcatttggaaacaagtatggtgaatccatctaggtagtttggtgtagggttaaaaaatgattataaattttgtgattgattttcttattggtccaaagactgattctggccagtatattctaggactacccttggtggtggtatcatggggataaaaatgtggctttctgagacaacgccttggaagcgtgtcacttgctggaacataggcatctcagtacagcaatatgtagagtagcacgccatgcctgtgggcctttcaaaagtcctcatgtgaacgtgagcctttcttcctgtggtactgatgatcattacgttcacgttgcaaagtctcattagtttgatttttgaacccagttgttggaaaagggtgttgatgtgtcccccagaaatggggaaggtgctgaatggaaacctaacttaatcgtactgtggattgaatgcgttgcctttttaaagaatgtcttggcagttcccgtgattttgtctaactctctggctattttttcctctctggatttagctctaaatcaaaaacccacacacaattactgcacaggggatgacccttctcagaaaaattccaaaacctctggagtagattgggtttttttacccattgagataaagaaggatattacaccatagttttgaattacaatgctgatatcctattcagggcttattaggatataacttgaagtaaatgttgagagtaatcagcaggacattttgaaagaaaagttacagttaacctagatgacagttaaacaattgtttatccccgataactgcattcagatgggccaatagcagaagtcactctgaaattcatgaaagtgtaactaacaggactgtcactactgcaagcagcatatttaatgtttttactgtttttttataaaaaaaggtttctattacagtgttcttgagtattggactaaaatgcaaacgtcacttgtaaatctattcctttgggcttcatgaagatttgaggtaggtgctcaggaagtgaatctccccaagaaactcctctcttagaatacactctgaccccaagcctgttggtagcaagactgcaggagcacatggctttgcaggcagcagaccttggctcatacccaaactccccactcactgaacctgcagcctcccccttccatcttcgacttctttatttggggaacagccacaataatgctggtggctgtagggactggggacaacatatccagcgcagagcttggttttattagagctatttaataaatgatggtcacaaatatgactattaataattagctattaattcaatttacacttggatttaattaataatagtaataagtgggtttattgtcactctaataagaacatatttgcaggctaaaacatcactcccaggaaaatcaccgtgttgacatatttatcttttcttaacattttcttctaccaataacgcagtgtaagaatcaaccttaatagatcactcactttgtgccaagctctgttctaagcactctgaaaatattaacatatgcaattatcgtagccatcccacgaggtaaccattgttatcccatttttccacgtgaggacactgtggtaggttaagacacttgatgaaagctggtaagtggtagagatatataactgttaagtaacaagaacacaattttatttcttattttatttatttatttatttatttatttatttatttatttattttttggagacagagtcttgctctgtcacccaggctggcacacagtggcacaatcttggctcactgcaacctccgcctcccaggttcaagcaattctcctgcctcagcttcccaaggagctgggattacaggcgtgcaccaccacggccagctaattttagtatttttagtagagacggggtttcactatgttggccaggcggctcttaaactcctgacctcaagtgatccgcccgcttcgacctcccctaatgccaggattacaggcataagccgctgcgcccagcctaagaacacaattttaaatgccaggattcatacctctaaataaaatgggtgcatcctctacaaggcccaggatgtggtgggctctccctgggctgtgactgtgtcttccttgaattgtcttcagaatcattgataagtcccacgcctctgtttcctatctccattgtcacagctgatttatgaacacaaacagtattgcaaaacttaacaccaccactgtttgttgtaaatttacataccttgtgactcatttttaaaaaatcaaatatagcaacaaagtacaaagatttaccaccactgactatgtaagagaaggcactaggagatcttaggatattatgctaagtggtatttcaaaggcattttgtatcttagtataagatctctggtgtgcaattttgtgtgatttgaatagggcctactttgcaaggggccacgcagacggatttcagcatcagaattgatttataccagtagcctcttctttatggtcataccacatatttagaatttgaactttctctgatgcagtagactgcatcttgctacctgagaaagatacaaaccaccctcatcttggcctgaaaagagcctctcccagatgctcagcatccagtacagggaagaagatgatatggtatggggggtttggagccaaaaattgatttgagacatgggtctttgtgactctagcttagtgacttaacctttcaacacctctgtttcctcccctgtccaatggggagattgacctcacctgagagagtgtcctgagaaccaagtgtaatgatgtgtgttgaggggtggggacagggctggcacagtgcctggcatgttctaaccatctataattttattcttttttcccctccctattccattctctctgtggccccatagagaagactccaatctgtggttttcattgatggtggcagctttagccaggcagtggtttccctgttgtacaattcaatagcctgcatgcagggacatgcttctcaggtggcctctggatacacgtgtcctttgtggcctacagaagactttcttacacagtgcactgttaactgagcagaggcagccgtacctggggtgctgattagcactgtgcaatgtactgattggtactgtgtaatttttaggacctccttttgttccctacgccccttgggagagtgtggcacactggaagaaagacacgctgtatcctgggcacaggtcttctgttagactcaatggtgggaaggggatgggatgcagcccagggcctccctgcccatggcattttctcaggagctgtctcctttgagttgctatcaaatcgcatatgttgcatgcttacttgaaaggaatttgcacagagtggtttgtttatactagttaggcatcaaaaagaccattgttctcccagactttcagtataacaaacaaatttaaaaaaagtatgtatatttgggtagataaatatagggttgattcctaaagggtttagaaataaccacaaataggcccatttataacaagaggttgaaggagagattgccactctttggagccacatctgaatgccagaagttcccttgacatcctgctcagtccaagggtcacaacatgtctgatgcctagctctggactcaagggcatcagacatcagaacacgtctctctctggactcagggacaatacccatacatatctgtggaatcaggataccttacctcctatctccagttcctaccccactgtgaagctcagagtgatattgagtgagccctttctgaatcgggaccagtctcatctcagcttattacccgtgggccccagtaatgcaatctgttcaccttctgaacactgggatccccgttgtcttgtcctaggtcactcatttgagagacagaagcgagtagaggctgtaagcatgaactctgcagccacagggttgctttgaatcctggacttgacacagctgtgtaaacttgagcaagttattgcaactctgtgtgcctcagtttacctatctgtaaagtgaggatacaaatgatctacttcatagggctattttaaaaatagttaatatgtaagtaactattagaatgcctagaacacggtacttgttagtaagagttattcattgtcatcatcatagtcattatcatcatcatcatcaagaatttgatgagtacctgtaaaggctaagcaatatccgaggctcatggggtacacagcaataaactaggcagggctctgttctttgagaaacttactctttatttgagacaaacaataaagagagctcttttagcacaaggcactgtaggaattccagtaacaaggagtcgtcctatgtagacagaacttgtgcatcgttgatgatctcgacgatcttgctaaattgaagcttggatgggcaagtaagactcagactttactccaagcaattccaagcatatgaaagcacgatgggcagatattagcctgccatccatacacagtattggatatcgcactctctgtgggacatttgctccttattctgacatcataagaacagaaaaccagtgcttctggacacgaatcatttcagggctctttgcagatgcatagcatgaaagcagctgtttcagaattcaaaaattatacatcatgccgtatatggcttttcgctttacaagttgctttcaaacattgcctcatgttggcctcatgacatccatgttagataagcgtggtgagaattacttccctgtttgataaacggggaagctgagtcagggggagctgcctcatcatggtcactaaagagaggcgagtgagacctggaaccccactgggtcttctgtcttctgggtgagctcttggttgaggggactgtgagatgcctgtgtaggtgagtctttgctgatttatagactcaatggactaattgttgctggatgctaccagaactatgaaacaatctgcaggacgaaaaagcagatgagtcatgcaaattttaacaaattagttatgtttctgaaattaaaagtaggtaaagaacacaaaagaattggaaacaaggactcagatacttatatgcctatgttctttgcagcattaacaataaccaaaagggggaaacaacccaagtgtctatcaactgatggatggatcaataaaatgtggtatatccgtacaatggaatattattcagccttaaaaagaaatgaagttctgatacatgttacaacatggatcaatcttgaaaacactatgccagagactgggcgcgttggcttacgcccgtaatcccagcactttgggaggccgagacaggctgatcacttgaggtcaggagttcaagaccagcctgaccaagatggtgaaaccctgtctctactaaaaatacaaaaattagccgggcgtggtggtgtgcacctgtaaccccagctacttgggaggccaaggcaggagaattgcttgaacacaggaggtggaggttgcagtgagcaaagactgggccactgcactccagcctgggtgacagagcgagacttcatctcaaaacaaaacaaaacaaaacaaaaacattatgccaaatgacataaactgaacaaaaaggacaaatactgtatgaatccatttatgtgaaacatctaggttagctaacctcatagagacagaaaatagattagaggttaccagaggccagagggaggagaaatagacatgtattgcttaatgactacaaaattgctgtttggtgtgaggaaaagttttgaatatagatgttggcaatggttgcacaatattgtgaatgcatttattgccactgaattaaacactgaattaaaactgcttttatattttaattatacactgaaataaaactgcttttaactagtttattttaattatacactgaattaaaactgctttttactagttttatcatatatcatactagtttgttgttgttgttgttgttttgagatggagttttgctcttgtcacccaggctggagtgcagtggcgcagtcttggctcattgcaacctccacctcccaggttcaagcgattctcctgcctcagcctcccaagtagcttggataacaggcacccgccaccacacttggctaatgtttgcattattagtagagacggggtttcaccgtgttggccaggctggtctcaaactcctgacttcaggtgatctgcccaccttggcctcacaaaaagctaggattacgggcatgagccactgctcccaccctcctactagttttattatatcattttaggttattataaaatcacagccatagtaacttcctgtgaggaaacggtttaaaaatatgagagcaggccacatggccacctaaggaaatttatacattttgagaagcgtgaaagcttattctatttccctgagaaaaggtattgatatcacaatgcagaggtgatcttattttaatttcagcactattactgctgtgcatttattacaatcaggcagagtactgatgtgtttcgaatacgggaaagacagaatctgaaaagagatagcaatttaactttctgcaggaaaactccggcgtgtttttcattctgacaacttgactggtgataagaaagatgaggtactacttttgtaaacttgttatccttacactctcaagaaccatttgtcatccatttttccctgtcatactgaaatatacctctaagaaaatatcggtaatttctcagtattttaaaaacatagattctcttgatcagtctactaaatatttcatagtttgtgtgttgttcattagaaaagaagagattccattttcccaaactgtggaactgagcagcgcactgagattttaaggagtgggatgtgggtaccctgagaagggacatggttttgtccagagctgaggaaaagaaaaattgaccccgagatcccagcttagccaacagccctgggcaatttcatcagcttcctatatctcggtgtagccacgagcaagatcattttgtggcactgaactcacggtctgcaactcatgtgcattcaggacagacattgaggcttagggtcaggctgtaggtggcaccagccatcatgggacattcagaccagagaatgcagcaaccaagagcttgcttaggtaggcaagcaggagcgtttgtccactccatagccagccttcatctatcaggggacttgaaatgttcattgcacattcccctgtaggcaagagtatttattgagaagacctgaattttaatgcaaagctttccaaatggttgtttgtagccagttgacctttgagtccagacatcaggtggctccattcctctccagggccatggagcttcactgtgaccttgggggactgtccagccctctccatagtgttgagggagcagctccagctcttctcccctcactcttcctggcctccctggggccagtatcccattgttaacaccagcaccagtcccatgcctatgatttcttcttttttttttttttttcttttgagacagtctcactctgtcacccaggctgaagtgcagtggagctatcttggctcattgcgacctccacctcctgggttcaaggaattctgcctcagcctcccgagtagctggaatcacaagcatgcactaccatgcccggctaatttttgtatgtttagtagagacaggggttcaccatgttggccagactggtcctaaactcctgacctcaagtgacccacccacctcggccttaaactgctgggattacaggtgtgagccaccgtgcctggcctatgcctgtgattgctttacttcagaaaagaaagcatgcagtgtctgacttctgagcaaagctgtggctcccaacaggaagacatcttacaaacgcaggagagatgcaagctcacttagaaggggaaacgtgcttagttaatgccagggttcacatgtgaccatgtttaaaatgaccacagagggaaggagaacaaaaaagcaaactttgctgacactcaaatgttttctgtttctaagtggatgaccctgcctttctagatacaacgggtttcattcttcatgctgggcaggttgccggggtttggacaaatcctgctcagtgcaaagcatctcccaaggtaacagtccctgctggctgctttaggtaaatgtcagcttgttatgctgctggacagatcccacgtgggccctgttctctgtcattgccatctattctccaagaattctgtctcaatgagaagaaaaacagatcaacaggggagctgaggaatagatgggagctgcgagctgcagagggccaggactcggtgtgttccccacagcggccatctgcttggcttgtggagacgaccagctcggccacacttctgagattaggactccctgatgggccagcagaaggggctcttgtcaaatcccactttccctgattaaaccggaacaggaatgtctggcagagtagaaaatccagggaggagaggtgaggcctgcatcctggagggaaggttgtcctgagatgttcctgccatttttgtccccaaaagcgggatgatactagaggcgatggggcaggatccatcctgaatgtgtccggagagttttggaagatttgaccatcactgcaatagtctttcttctacagaaaataagtccggtaaaaatggggcaaaagttactcccacccagaggaatgagacatatgtgtccccctaccgaggggtgccccagagagtgggcacctagaagatctggttgttccccgcagtcacatacctccctgaattgaagtccttagagccacagaaaacttcctctggttttcttactagttactgttggagagagggtcattcctgattcctcctccagtgcagcctggcaggggagcctgctgagctctgctgtgtgaactttctgcccagagacaaggacagggatgagaggaggcagcaggtgagcagaagacaagacactggaagataagacctgtgcatcaggaccgagggaatatatgtgggagagacagagtccactgagatgcctcagctacccagggttcccactgtaaggaagccaccagtgtccagaggactccaggaaaaactcggatcccactttctgctactgaccagctgtgtgacctcagaccaggagtgcaatctctctgcacatctgacatctgtgtcaattcttccttaggagaggagagacgatttatgccttacccacttcttaaggcagtgttgaacaatgtcatcatgtgtaaaagcattttttaaaataagctgttgtctgcatggaggccatgattcatataaagcaatttgatttatacaatgaatctctccaagttttgctccttgcaaggttctgtgtcaataaatgttcaaacccatatttattgagcacctactataaataatcaggcgctgttttaagcacttctgatatgctggtaaaaaaaaacagatgcaaatacctgcctttgttacgctgacattctagaggacatttaaagagatctagttccatgtggatagagcaaaatgaaagggaaagttatactttagcacaaatgtcaatttcagaatggtttatttttaaaatgccagactctgccatcctgagattgactaactattgtctcaccatctctttgtcctggttaagttcagagaatacaatgtgcccagagtgcagccctgtttgaaaaggacggcttgcagagttgcagcaaaagtcatttctgggcagacgataatactaaacggaagctgatgaaagaaagagaaaaaaataccatgagagaagggggatgctggtgaaggtaaaatgttagtggagaggtagatttcaaatagaatcgcctaggttgaaaataaaaagcagtcatcaactatgatggaaaaatatttccgagacttgataagtcatccggaccctggctgctcactcccagggttgcgtgggatcctttgcaggatgagcagaggctgtcagtgtgggatgcgtaacacagcaggcacagggtaactgatctaattatgaagagcccttcccatctgatcctgactttgacctatggcttgtgaggccccagcaacattgaatccagggtgaaagtcagaaggactaggacccactcagctagttcaatcctctcatgccttcagtggctggagatatttagggagcacatcctatatgctaagccctaaataaggtgtcaggaatatagcagtgaactaggatggcaggtcccttccccaatgaaacccagtgtgggacaaaatgtgatcctggaaggtgagggtgattctgcaactcataaataaactgcgtgtgccagtagcaggccttgtggtaacacctaggcaggaccaccttctctgcacaacttcagagagcataacttaatttttacacattgaattttgatgtatttatttgtcattgcctaacatcccaaccccagcgtctgatggggatggcagtcctggcgttatgccatgggtagggtactgaggctagattccctgaatcctgaccgagtctcatcccatgagccagggtgatgaggctaatcaaacaaggaaccaaggagcccataggttgaaatacaaggtttggaagaaaatgtgatgcttgctggaatgaccagatgggcgaggatgttgaaaaataaatgaggtgtgatcattgcaattcattcccatcattacgaaatcatttattattaagttacacatggacacactgcagtgccaaggaaaagtacaaatgaaaggtaaaaacaagggacaaatgttgctcatgttgccagtaccttgttttgagtctggaagagaattatttatgttgctgcagccaaacgtctctaaagaaaatgatcaaattgtaattggtcaacatgttctctcaatgataccttgatacatcattttaattttaagtttttattcatctctaatgttttacttcaggcacttcttatttctttcttggaccattccaaaaatgtcctaaactggtatctcggccccagtccatcttctacgctctgaaaaaatacctttggttttatttttgcagagtcgattttttcccttcgtggatgggctccttggcaatctgagccttcgccctgctccctgccacccccctgccttgcactccaggcatgcacattcatgaaaattcctcaaaatcttagggaggctgaggcaggagaatcccttggacccgggaggtggaggttgcagtgagccgagattgcaccattgaacgcactgtagcctgtgtgacaagagcaaaactctgtctccaaaaaaaaaaaaaaaattccctcttgctcatgactcatttgtatgtgatgttccacttggcagccattttcctctagtccactggcccctggtgttcccgcggggcttcttacatgagccattctagaatcgcaggtcccttgctcttcctctgcacatgcctgtgtttatctggagagagtctgtttgtttccctgtttgccttcttaccagacttggagcccttcaaagccaagggctgtcccatatggatagaccttccccagtgtctaaataggaactgggatatgatagatgttcaataaaaattaaacaagagacaaaacaaaagtagggaccaatctggaatccagtaaccatctctcatttcaggagaagtggaaactctcaggaagttgaaaatactgggcttcagaacctgacctagtttgcagccaccgctcccctccaaaaacaatcccataagaattccttctgacccctgagatgagagggtcactgaggtggatcctggccttggaaatccctgttaggacctattgggaccttttacttgcccatcaccaccaccctaacattacattagaaaccaacttgggcttgaaatggaggcctctgagtttgcatgaaccccaaaatgcaggctcagattggtttcattgcaaaaagggaagttgcattccagttatctctgaataaaacttgtgatggtaaggacacagcccctacccctagaagtgaaaactggcaagtctccaggaaccaagaccactccaaggtccagttcttgcatcagcgaggccttgcttccttcttgcttcttaacaactggattccatgctcactcacggcttctcctctctctacctctggaatgtgcattgctgtcagagctgctttgtaatggctgcgtcctcatagcctagactctctctcctgagctttgaagcttcagtctgccctgctagccactaacagactcctgaatttctaagttcaggttcctacaatggaaaataagattgacctgactcatttcttcatgtggaatttttggctacagattggctgttgtttggtcaggccacaaaccccggtccaattgaccatgttttaccatattctcatcttgtccttagaaggttgcacagaggtgagttactgaccagaatgaacctaggcatggacatttaggaatttcctattaaacataaacacttcagagaagaaaagcatattccatcttaatacctcagaataaaggagcgtatcagcttcattccttttcagaggtacagcaggaatctatacacatcagggggccagttaatctgaaggatgagggggacgtctgaaagcagatgaggagaggaaaggaagaaggtagccctgaacctctgaactatgttcctggatctcgtcaatttagtccttactctctgtcaagttgatccattgacagattctcaaaaccaggtcaatatagagatatggcactcttacgtcttgtgtcagctgtatctgttatcaatagttttatgaatggcaccaccgacaaaggataaaaacctaactgcgattaggcaaggaaaatatatatataccagattttctggtcccccacaagtttcaccctagtgactgttctctgtcatcccacgcagggtgggctttgagaactcatcaatcctcttgtgagtttcagtcttgcatcttttctgggatctggctcaaacgtggctaatttcccagcatactatgttcagtacaagggcaatctgtcagcattcgtctgagcatgtttgtaaagacacataattcactatgaaaccaattcatttcagatgtgctttttcccattgcaccaaagccccgggttgatttggcagtttggtatattatacaaataaatatgtcgaaaatgggaagttaacaactgttggaacctgaggtttctgaaggacttggctctggtgtcaacttcagaaggtcatctggagaagctaagggatctgaacattcttaaaaggaagagaaatgctttagaataaaaggaatcctgtgtccacaggcaggcagagtctcgtttttgatttcctagggaacttagcacagtggagttccaatagctcataggaaatcgcgtttcacaaaagttacacaaaacaatacctttctgaggagtttatgttctaataggaaatacctaaaatatatttatccactttttaaattttattctaccttctctcttttaacactgatttacataataagggacagattaaattaatttcataatagaaatcttgggctttaaaaattatcttagaaaggtaattgtcttcatttggtgttttatgttccctaagtagttatctttgctgtttcttgtgggggttgctggcaattctgacttcccattccatatctcatttattacttcatttaggaaatactctttttttaatttgataggctgaggtctatttcctaatgactttcacctagttttaattttcagcaaaagaaacacttaagatataagtcataggtaatacttaggcctgtctgatgaatgacggaatctagcttccgctggtatttcatctttgacttctaacatgtaagaagccttcactttagtggtcatctctcctcctttttcgtccttgctcctttcagaagtgttcatctgtagcgtaggattcagtgatccccaagtgttttaagctgcagagctctttgttccgatgcttgtaattcacataaaggagataaaagtggagctgtgtgggctgaaggatgagaaggggagaggggggaaatggagccccaagttctagacaagcctccccccatcaactccttcatcctggcagcctaggaaaggttactctagcacaatttggaaacatctggctgagtcattttggcccacattttctttctgctgaattcatttgcattctcccagggcgacatacataaatgttttctagttcatgttgacatctttcagttattcatgaactgtgaccctactaccctgtgaggttctatgagaagctctgtgtgttgcaattctgtctgcattgctttgcagatgatgagttgcctaaaatgaatgaactggttctgacctatctaagtgtatcacatggagatgctcttgtctcttgatttcagtctaggtgacactcaggttttccaaaagttctctccctgatacacacattatttcattgtttcctgtgtgctaagcgcacacaggatgcaaagatgaataagaccttcccttacggagccctcagcctagccatgacgagagccagttatggagtccctactagatgtccattgctttacatagtttctatctcattaactttggtgcacatagccagtaagcgaaaggacccgggatttgcaaacaagaaattattctgacttcaacgctcattcctttcactgatgggcaaccctttatcttacctggtccctgccacggagaaactcacaggcagggccgggcagagaagtggtcagtgatgctctaaggtaacaagcacttcccataagcctggggtaggaggtgacatttgcacggggcactaaaggatgattaggagctcatcaggtggaaggagttgggagtggggctggagctggtgtctttgctaatgccttctaggggaagatgccaagtgttttagatttccattgcttatacttatctccagtttttagtggcctacttgaatgtcatttatattgtcatttacaccactccccaaggccaaatcatatctgtgttgcaaagttggccaacagggattgtatgaactgagccttctctggagattttctgcatgggtctgttagttcatgtatttcatgttgagaataaagtatgggcacgtgaaggtttgggggatattttacataagacattctcctatgtaggcatgaaaatctttcctgactccaatcctgttgctaaacagcgaggtctagcccagaaggcatggaggggagcagagtttctgggaaacaagaagaggacttggagccccagacaggggacaactccagagggtttcttggggatacctttccctacaggccactgaagacagcacggcagtggaaacatctgcatcacccaccctggtgtgtgttcccccgacaatctgtgggcttgttccacagctggcaccaaattctggctgagcagacagccccagaaatgtcacctggagccgttaaaaaaacataaacaaggcatctgtcacgctgccgtcgccaaggtcatctggtggcaggaggtgaccgaggaggagcatggtggtgccgtgccatcgagggccaacctgtgggcagacctgcctgtgccggcgctcccttgctctgcagatgcattcaaggatgtgaagttgtgcaggggccagacgtgagaagcaaaacaacctgaatgaaatccagccactttggagtgaaacatgagcattttaaaacatgattttcaaactgtcgcagggttagtattgcatctggtctcctctcatgattgcctggaggccaccagcccaaagctggagtgagacatgagctggagggtaacctgaacaccgaatttagggagtgtgttgttcatacaaatcactcagactgagagttagagatgggatttacacccaagctatccatcaaaccactatctgtgtgaccttcgacaacttatccatttcctctaagccccaattttcatatctgtaaattccctcctaggatccttgtgaaggttagataagatagtatgtgtaataatgcagggctgcagagggccctcagtacattttattttggctttctctgccctcacttacaggtgagggaacagatttagagacggggagttcatagcataccagcatcaatgatcctagcaagaactgtcgtactttcttcctccttccttcacttcctttttccttatttccctcataatccactccccttcccctccctaccctcagtgcacatgatattatgtttgatgggtagcttttggtttgtatataattttggcaaaacacattctttgtagaaatgtattctttaatttgttaaatggtttgagtttatacatggatgccttatgtgttttgtgcgtatttacatttatatttagattcctcttttttcttaagtactgtgtctatgttccctccctgttgctctgtgtacacataatcgattgcttattgctctgtgtatgcataaacagttgcttcttttttttttttttttttgagacagagtctctctctgtcacccaggctggagtgcagtggtgctatctcggctcactgcaagctctacctcccaggttcacgccattctcctgcctcagcctcccgagcagctgagactacaggcacctgccaccatgctggctaattttttgtattttttagtaaagacggggtttcaccatgttagccaggatggtctcaatctcgtgaccttgtgatccgcctgcctcggcctcgcaaagtgctgggatgacaggcgtgagccaccgcgcccggctgccgttgcttctaattgctgcttagccttgcatggttgcatccagtctgttccacaaggatggacacccaggttgcctccacactatccccatagtccatcttcttgtaattcttaagataggaccaaaagacatttatttacaagtttccctcttctattagacggtgagacagtgagagaagatttcctgactttatatacaaagcagctagcacatagcagtttctcagtaaacacaaagccattggcttcccaggcagctggacacatgggctcaggcccagcctcctgtgtccttggttcccaggaaaagtgacagccttaacggcagcactgtgattaccgttatcttgtcatgaaggtttatgacgagtaagggaagtgccttttaggaagagaaaagatgaaaagccttcccatgtgacgtatactagaattccctgaaacctgaaggccccacatgatgcacctgtttattcaaacacatacatttgagtactaactgtaagtgatagtgggtatggatttggtgaactctttgaatgctttcagcatttccccaatctgtaggagattctagttccttagaattggatactgagccctgtttgatgaaacttgctgtggcatttggagaggatgcagctagggttcacacatttaaccatggatggatctgtcagtcagtctcagttcatggtagacaagaaaggagatacatgctgacaagccgtgtaggaagtgtactgccttaagcagtgtaaacatctttattcctgaaaggcatatctgctaggttgattgtgaaatgtattctgtttttttttttttgttttgtttttctatttggagggtgagggatagcctactttaatatcagaagattttttttttattgaattgtggtactgagtgaaatgacctacctttacttgacctgcaacagagttgctgtagaccaggggtgggcaaattctttctgcaagaaccaggtaataagtattttacactttacggctacatggcctttgtcaaacctgtcacctctcctgttgtggtacataggcagccattagacagtctataagtaaatgggcttagctgcattccaataaaactttattcacaaaataagaagggggccaggtttggcccatgagccctggttttcctacccttgtttagatgctcatgcacttgctacacctggaaatcaacataaatatagtaggtccaataaggcaaaccagctactgtttcttgccagtattctctgctctctcttcaggacactctgaacacaatggataggagtaatatgaacagaaaacagaagaaggacttggactgtatcaattttggcttggttgtgcacgccagaaaacctaaaataacagtgcccagtacacagcagaagtttatttctctttcttgtaaatacagtttggagacaagcagtccagggatagcatggctcctcttctcacaaaagcctctgctccttctattatgttttctcccacgaagggtttggtctcatggttccagattgtagcaagcattccagataggcagatgggaaaaggcgggaaggagagggagagtaaatgaagagcgtgcacgctgacagatgctgcgacgagcttttccagttgctgcctgtcatggttagttttaggtgtcagcttggctaggccacggtacccagcttcttctcaaacaccaggcgacatgttgctgtggagttttgttttgaagatgtgattgataattcagttagcggacatggagtagagcaggtccccctctaccatgtgggtgggcctcgtccgattagttgaaggctttaggagaaaataatgaggtctcccagggaggaaaggattctgcctccagacagccttcaggcttgagccaccatcccaactcttccccgggtttccagccagctgccctgccctgcagacttcacatctgccagcccccacaatccaccatccttaaaaatctgtctctctctctccacacacacacatacacacactattggttgtgcatctctggagacccctgctgcgtgtgcagcctattcatctagaaggctccggggcagtgggggatctactccttatccacagcattctaatattctggagacacaagagaagggacatggaagggcaggcagacattaaactacccagaagcgatgtgtgcctgtgctcttattgcacctccacattcttatttttcttactaataaagaatttaaaatgaaggaagccccagatcacccgggtgtgattctctagccttttcccacttctagttcaagagatgtacccgtgttcttttaaccaaagaaaaaatcattgcatcctttactctagcagtagtgcctgaagcatggggtgaaggtgatgagtgcgttagggcctttgggaactctgtcccagccaaccctcaccgtccataccctgctgggagggaaagctgtggccccggcagctctcttggtttatactcccaagaggaaactcttcctctcgaagcctgggggagggacagactttggaccaagttcactctcccagctataatttgaagtgtggacaaaatgggcccagatgttcagccttgcttgttgggcctggctctggtctgcgttctcatccgcgagaccctcggcctccctgcccacaccaactcgccttgggtcttctttgagacattcttactgaacaagaaataattccccagggttagattactggacacaggagaaatgtgttctgcaagctgaggagaattgaatttggcttcagggacttcctcctccccaggtgaggtttaccagtctgtaaggatctcacaggtgatttgggtccatttttggtgcactttatttctcttcctagaccctttcctctgtcttcccagacccttcccctcaaaggggtgctggcgttgggttgcccacggctccttgccccggtgagccctgaccacgcagacccagcagcttccagggacctcagcatttaagtaatgggcgtgcaagagaaaaccaaaaccaaacccaaacaagcctccaaatgcagggagaactcctcagtgggagctggagagttctagttgaaatgtctgaggtgacagtgagcacgcagtggtcgactgtcggaaagctggtcctcaggccagaaaactcatccacagttccatcccaacttggtctttttgtatgagttgaagaaaaagtgtgggttttttgttgttgttgtttctttctttccaactagtttctttggatcctggcatgactccagaagaatcgtaccctgctgccccacattcatttttatttttaggggattgtaagttagaagaagtgacttctcttgcagatggcaaagacttacaatccaaaatcatcacaactcacaatttaaagacattttgatctctaccttcctgagcaaatcagccggcaggcctatttcttgtagggctttcgtctgcacatagtaggtcctggataaacacttgctgattaaatgatattcgaagcaaagcgactgcagctgattgtctacttagggcaaggtgagtgtaaatcagaagggtgagaaattgcatcaggctgcggagggatgcaggcttgcacggctacaaacaaacctaattagctgtgcctctgccagcagccctactcagacacatctggaggggggagaatggctaaggctagattggctttcccaagtgaaaacgcctctcttcagttgcacctgcacaggactgattgcgcctcaaatccatttgtcaggctggttgcaggtatctgagaaattgctaatagaattgggcaaaagtgcccgtgggagtgggaggtaaatagcatggcaagacaagcggctgctggagtcccgggttggcaggtgggcctgcccccatgccccgccaggctccagggggtacctatgcccagtgactacagagaagacccgtcttggctgagcatcaggctctggtgcagtctttgctaagtgtgtttatcggccaccacgagagtacttagctgcaaaatggaggtgctttcactcacagacaccaggagccttcactagggaggcactgagatcagcactttttccaagatgctccttgcaaggtacttgtgctccatcaaattgcaattcttcctagacacaaagggaggcactggcccagagtcaaggtcatagcaagaccccttgagctgcctgtttcttagcagaagctggagtagacagacatgacttgagacgtcttaaacttgtttggagaatttgggactggatctcccgcccaagcactttggaggggtctgaagagacacaggacgtgtgtatacgtgtgtggggatttggggctgtgtgtgtgtggggttggggcaagggcttggatcaaacatctggatatgaataccaactctgctgttttctgctgactgtgaacttggaagagtttcttatcagttcaagcctcacttccctcataaatgaaatggggatagtaatcattattatgggctgttgggtcccccaaaaatccatgtgttgaagtcttaacacccagtgcttcagaatgtgatgatatttggagatacggtctttaaagaggtgaatcaagttaaaatgaggtcctatgggtgggccctaatttaatatggctgatgtccttataagaagagagattaggacacagacacacacaggcgatgttatatggtggtttagggtctagactgccaaggttcaagttctgctgtgacttacttgctctgagtgaccttgggtttcatattaaattttctgaatatcaatttcctcacctgtaaaatgggggaaataacagtctgcctcatggtgttgctggaggtgtgaggtcagatattaaccatctggcacttccaccgctgcaggtagcttggccattgttattgttatgattaagggcaggtgagcatgtagtgtctttctttgctaagtatgtctgatgccaagtcagtattcattgagcacctcttctgtgcaaggcgcttggaaaggagtgcagtggctctttttccccactcttgcccctgctagattcatcctcaagtcttctctgagttgcttttcctgcagcccgtagttactgaaaaccataatacttatagatgctgctttctagaaatgagcctgtaaagtcttgtattttctcttggtctgcacaactttagggggggtaacacgtcctgtatttgccagttgttaaccttctctttgaccacggagctctagatgatggcaccgataatgcccaggcagatttagttttgatctccaatgaaagataggcctttctgtatttgcagtaataagcaaacacctttagcttgagaggataaacttaagtacaatgtttgttctctggaggcatactgattaactttaaaatatgaataaaaggcagtcctatttcattatggtaagaacacttaatacaagatctgccctctttttttttttttttttttttttttttgttggagacagagctctcacccgggctgtcacccagctctgtcacccaggctggagtgcagtggtgcaatctcggctcactgcaacctccacctcccaggttcaagtgatcctcctgcctcagcctcccgagcagctaggactacaggagcgtgacaccacgcccggctaattttttgcatttttagcagagacggggtttcaccatgttagccaggatggtctcgatctcctgacctcgtgatctaccctcttaacggatttttagtgtgcaagttatctgtaggtacaaggttgtacagcagatctgtcaaacttattcatctcacataattgagactttatgcctttcaattagcaactcctcacctcccgctcccaccagtcccaggcaaccactaccctgttccttttgcctccgtgagtttggctactttcaaagcctcatagaagtggaactgtgccgcatttgttcttctgtgcctggctcatttctcttggcatctttcctccaggttcattcatgctgtcaccaatggcaggatatctcgctcttttgtttttaaaaacagccaaagtcaagtatgtaaaaaggtgggcagctgagaacctggtaccagaatgttccaaggaaaggtactgagtggcacaacctggcctggttctccaccagtaattcctaaacttccccacctggaggctcctgatgacagatgggtgaatggcagagtagatgagtgagggaggtggggagccccggtggggcctggctggtcaaagtccaagcaatctgatcccagcaggacattcctttgaaggatcatgtatcactttacaaatatccacaagctttgcactctatccatatttgtttaggtgtaaaaaaatattttaagctctttactgagaaggaaaatgggatgcacccacatggattccccagcatgcaccgctgagcattccctgtggtaccgctcctcagtttagggtttaggtcaggggccctggaatcattgaaggagacctgtcttcctctcgtctgctgtcttcctcctggatatcacccctgggtcaagcccatggtctcagtgggttagcaatgaatccttcctaagatgcgaacagatgggagctcaacatttgacccatccctggggttttagtttttttgtttgtttgtttgttttgagacggagtcttgccctgtcacccaggctggagtgcaatggcaccatctcagctcactgcaacttccgcccctcaggttcaagcgattctcctgccttagcctctcaagtagctgggattacaggcatgcgccgccacgcccagctaattggggttttaggtttaagaggaatcccagaaggacagggtgatctgaggtcctgagcaactctgaggctgaaactgcgctggtctactttaaggcaggggctgtgattttccctgtgactgaggtcctccaggggtcaactgcatttcaggtgtgtgaggggagagtgactgcccacctggctacccagcccttctttctgagcctgtttactcagctgctggggcctccatgacaggtttgcttggtgaccttacaccgcagtggctcccagggccagagacgtgaccaaggagggaccttgcactgaggaacctgtgaccgtaggaagaccctctaaggccgactcttgcttggcccggcccagtccctcctaccaacactgataagaacttaggttcctagcatcccaggaggcagggtcacaaagacaagctgagaactgataccactgctatacccacccctggacctccctgtcccatgcaggagtctaagccagtgcaaccaaggccaagcacacacccataccacacagcaagggtttcacacggggttttcatttctttacccctggccgaaccatgcaagctaccagccatctacccagacttcttagagtctgccaaatacgtactcagaccagaattaagttcaggccatggtagaggtgaccagccactctgccgtgacctggattcagccatcaattccaaagaagcccacagtgccttgcattttgctggctggtttgtttttgtaaaatgatggggtgggaagcagtgctgggcattggaaaggggctgaacaaggggaaatcttcaacaccttttaaatggaagcatgtctagttggcctcttttctgtaaggaactatactgggcatcacagagatgcaaagactagagtgactgattcaggccctggcctgaaggactttattattgagagttccccgtatatataaatggctgaactctcaggccagtgaatgcctgtgaccaagtgccaatgggtgaaagtagaggttccagaccaggagtgggaaatgcatcaacagagagcttggccacatgctggcctggagtgcagagaaagagtgccaggcctctgggcactgagttctgagctgcttctggagggccaggagatactcccacctgcaaatgactggctgattgcactttccttagagtttgccacctgcatttccgctctacccactaactgactgctccggtgcagggagccaggcaggggcagtggtacctgggtcaggacacgacagcagcctctggcctcaggcagggagtgctggacagtccgtctcctgtcctgctttgtctctttctccttgagctcaggacacagtggggagccctcatgtttctgtaaggtcatcacacaggctggaatgttttttttttcctctctctctctccctgtctttcttttaatggacaaacacccttgaggtcctggttgattttcttagagaaatgtagattctttgattctaacgatggaacataagttttctgaattttgaggaaaacaaagcccaagatttcaacaaccagtgttcctgccaaatccactgggcaaacagaaaagctgcctgcctccggtgctcccagacccccttccttctcaaacacgcatcagacactttgcaccaagaaaaaacaaagggcatccctcctggggccacctctgccccctgtccaggtacgcgctgtctggcgcgccctgcgtgggggccgcaggttcagacacccgggcgcggcgcggggccctgatggatgcggtgaccgaggctgtggctgcgggcgcggcgtctccgcggcagtcgctgcctccgcggccccctccccagccccagccccagccccagccccagccccagccccagccccagccccagccccagccccagcccggctgagcgggcggccggagcatgcgccgtgggcgccgggccgggaggcgggcgaggaggcagcgcgcatcactcgggtccccttcctgcacccagccgccacttgccggttgctaagcagttatcattgtttctgtggcgattgcagaggctgttgctaattggagaagccccactaagcagcggcagcttcctgcttcggatcctctctctgctgcttgcatttaaagagcaaactcgtcttgtctacccaccctccctcccccatcctccccaaaatagccttgtgatttcggaagtatggactaaaatcacactcctccttaccttaccgcttggactctggtggctcccaactcgccgtcagaccccacctgccccggtggtgggaagcgcctggacagaccatgaccacagccaaggagccaagcgcttcggggaaatccgtgcagcagcaggaacaggtaatgctgcttttgggggtccgtgtgtgtgtgtgtgcgtgcgtgtgcatgcgtgcatatgtgtgtgcatgagagagacagagacagagagggaggatatgtatttggggaagaattttgtattttgtattggtttatgactgtagccccctgagccaccaagctgggaggagacgtagagtgctgggtgctgctggagtctgcggctctcctctccctggcttctctctctaaagggcgccctggcttgatgattaaggtacaggcacagggaacctctgtcaaggtaaacttgatgtgaaacacctctggacaaaggcctctctctacagagccgccagatctaacgagttccctgggaaggttcccagctagtactttgtaacttgggggaagagggttgtagccagaaacatcagcgtattctgaccctccaacaggactttgctttggttctaagacaagtcaaagaaaatgagcttactgaaaggacttttctttggatacctcgtggccctttcctcctgtttccctcaagagcaaactgtccctgctagagaagccgaaggatagacggtcgggataaaggaggactcggccgagaaggtgcaggtttaaagggctgaccgcggacggggaaggctgcgtgggtcccacatggcacagggcggccgctcgccttgtcctgagaagaccacggtctgcagaggcccaaggggtgagggaggaaaggtgagtcagccagccgcttcaccacgcgtgtagacatcgtaattccctccttggaagatcttgagggttcttgtcttttaatcattgctcagttcacctcaggcagatcattaaaatagatcctgggagacaccaatagattcacaaagcagtttgctcaagcgtggtaaatcaacagcttaagctgacttctcctatttattttagggttgctgttggatctcatttgctaggattagggcaaagataggcgacctctttagagttcaggaagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatataccttgaggagaccttacctggggtctgaacacactgcttagaacataaagaggtaaataacctcctaaaataaaatccctaaagacagtctcttattcctgcattatatataattttgaaaggtattaaaactatgctgtgtgcttagactgcagaactcttaatgagttctccattctttattttattttattttcctggttgctaatgaaacttcagggatacctctattcccaggctggtaggcatgtgtagggagaccaggaaagaggaatatgtttctttttttttttttttaatttattttttgagtgagagagaggattgctgctttgtggattggttttgaagcagggggtcattaaactgtgctaactcaatgactgcctgcaaatcaccaagtgttgattcttatgagaaactcactggcacctcacatcctcatcttgtgaggcattaaccagagaactgggattgaatggagcctgatgccatctccgacatccttccagctgtttggttactgcaatagactacccattacttcttagcaagtgaacagaggaaagtgagtttctttaccagccttggtatttggaaaccaggcatatgggtggtgggtggaaataatttttgtgtgctgaggatggccacaaattaggggggaaattagaaaaaaaaaagattttactattagttagagattgttgttttttttctaccgtgtttgctaaaaaaaatgtgtaaaaagagtattttgggatttttggtttgttttttaaaggatactaaataaacaagccagagtaacaaggagaattggcttctgggagactatttctctttctctttggagatgctaaagtttatttttaaatgaagtattgcaaacccagagatgtttggaagcaatatatactttaatctgcatgaactgagttgatcctttggctctgaagccaatcaggtgatactgagactcctcggtgaaaatggctgagcattggctgcacctgacctctgctcctgcgcagagggaagcctggtgagggacccagaaaaaacactgaggcaagtctggcttaaatttactatattctcacaagccaacggagctcttccttagaaaaccaaattaagggattttttttcccttaaaataaataaaagtacaaatttattgtagtacatactgtctccatttcaaatgatttaaaattgaaaagcagtgatcagtaaagctattaagagaagacgaaaaattaattccctctgcttgcaatgagccaggacacatttttgctcaaatattaagcagggataagtttttcctagcatattgtgtgcatgtgtatgtatgtgtgtgcatgcgtatgcacacacaaacaaatgcacacacgtgaacagtcacacacaggcacacctcgtgtgtcacaaaatcagagttggaaaggaccccacacatgcactcgttggtcctagttcatgctctcgtgctgaggaatctcacaaatgtgtgagaatatgcctttcctcaaaagatctccagaaaaacctcctttcacatggaaatagcctacattccactggctaacttggatctttggttatatgttcagtcacatttttaacttccttagacctgaaaatcagctgttctcatcacaccttgtatatgtgactgctgttttttgttgcttctcagttttcttcaagttgtacaaatcctgatagataactccccatgtgtctgttcttctattaaattatgagccccaggacctagtattaacttaaatttggtgtctgaacatatataataatgccattacagaagaactttttgaaatgaatagaaatttttaaacaacagattccatagaacggacattgaaatgcatgtgaattctgggagaggttaggtggcctcccggaagggcacataggtaatggcccagtaagagaatttctgatgttcctgtccgctgctctctgattttgatcttgttgcttcttgcagtagatactgaaagagaggatctaactttgaccataatgagagttaaattttttatgtagccatattaaaaggcaatgtgagacatccgtatttaagataaatgtggtaacaggaaaaaaaagaagtgaaaagaacacagaaaaacaagattcaatattaggaagtgcacataactattgaggagtcccaatagggaaggtggtccttttgcagttcaaaaagggcatggggtggggttggtggccctttcacagttcacacggacattggatgtagcagccatgctcacgtacagtaaattccatctgtgcatggtctaaattatctaagactctgtagataaaaagaaaacttgaaggaactgctgaagaatagggacaccaggttcttaggattgtgtagaagtacatctgggactcatggacttccagagccgggagacaggatggagtttggctgcaaaataggctgatgtgtgaaggatttgaggagagaactgggaagtcttggatatcctacagagagcaggtccagaaccagagctccctactgggaacaccagagtgggtccttgagctgatggggagcagcatggagtctttggggaagggaaagagcttagctggtgtggtgctatcctcagaggagggatgttttgcttgttaccaaagagaacaacatgatgaggaagcaagcacgcaactagcctggaggcggcatgcgctgtgctctgagaactgacaggtagttcacaatcttttgggatccgtgtcaccaacttactaaaaagtgcaaatcagcaagtgccatttagcacatcaaatgaaagcccaggcaattgagagcaaggacaaatgatacccagattggcttttggtgcaacccaaactcaaaacaatggaaacagtgtttctgtttggttttgttttttaaaatgctttctctgtgcattaaatgcattttgttattttattctgacattccattaaaccaaatccagccccctcattctcaatactgtggttatcagggcagatatactcaaaaccttcaaatgctccatggagaacacgtgagggctggagggtgcttttcattaaccttcaccgaaacatcttagctccagcgtgcacgtggaaagtgttaagatgctaatcacttagaggaatgaacagcgtgcacgtggaaagtgttaagatgctaatcacttagaggaatgaacggtcaccgtctctgcctcatcgggaattgtagcgttattatcttttatggaaatgagctgtgcctgtgtttggcactcactgatctagttttgcagtaggcatcatgcaccctctgtcattgagaaagagagggcagagtgaatctgtggatccagagttctaaaacctgaggaagagtatataattcggggagaaagtgattctctataagctctgagaggtcaatggttgacatccttgcttgtaaaagatcggacaggtagggggtgtatcatcttgtttcagacactgtttggaaaaacaaaataaagtggttttatttgaagatgtaggcttggttaccccatagccttaaatcatggaagtaggtaaccatgtcaatttgcatggggagccgcgtgcagtggctcatacctgcagtctttgggaggccgacgagagaggattgcttgagtttaggagttcaacaccagcctgggcaacatggcgaagccccatgtctagaaaaaatagaaaaattatccaggcgtggtggtggcgcatgcctgttgtcccagttactcaggaggctgaggtaggaggatcacctgagcccagggaggtcaagtttgcagtgagccgtgatcacaccgctgaactctagcctgggcaatggagtgaaaccctgtctccacaaaaaaaaaaaagaaaaagaaaaagaaaatctgggtgggatgtaaattgcaatcctgtttgttggtgcaattctgcatgtggctgatatcctaaagtccttcctgactttgatagcatgtgtttcttgaagtggggagtggagaggtctcaacacacacagcccaggtagaatgatcaaatccagaaagtttattctctgtcctactcccatccccatttgttgttgacctttcaggactctttacttctacatcccgggtaggcccttaatctccactggtacccatggtttagcaccattttctcatacttgactcttctatcaaaaatgctccatgtgcttttccacctgggccttgctaaatgactgagacaaatccattcattaaacaaaaagtgtaaggtgggtgtcatgcagtactttcctgagagcatttgcaatttcaacagtagctattggtgataaaacccaatgcaattattaatggtggaaatttcaggcacaaagttgtggcaagacctgatggaagaaaaaatatttagtcacatcgttaaggaataatgaaggtgaggtcacagcggggacagtcttggcaccccttaaatcatcgacaggctgtgcacatcctggaggtatctgttcattctgtgttcacattagagctggtcttgtatcaggcaagtaccaaattacagatcctgttgctgctttctgctttcaaatcctgaaggatttgatagtaatagtgttgaaatgtgcagcgattccttcttaggaaaaactgccataatatgcacaggcatggagtcagtgctgtgggtcccctttgatcctggtggctgggatcctgaatgcagccctccaccaatggctttacaaagcacgttgctgatataatgaagtcttgctccgcaaatttttagtgacaatgtatgtaattattcctttactagtatctgatccatttttaagaaatttaacttcccctgccagaattcaagaaaaactgctttccccagtgtggaactgcacgagactcaagcgtcacctcgagctgctaagttattaatttggaacacaggcttttaaacaatatctgtatgtgcgcccatgtatgtgtgggcagagggggcgatgggagaccagccaaatctgctgattaaaatgggaacaccgtggtgatggcggggctctctcaaaacactttaaaaggccgaagtccatcttgtggacatgctcataagatttctcttggagacaatggtaattcattctcttaaaaaggattggttcaaccctttgagtaggctacccacagcaagatgtgagatcagaaccaaaaaatattcaaagcatattccatgttttgtcttttggaaataatatgtgacagaggtggtcttgaatagtaatgatatatgtttccaaattaatgaaaataagttatttctttattctctagcagtgattcttgaaattcttcattctttttagaatatttgaagttgttatagcattcactctaggaattccaaaattatgacactaagtatgtatctcaaatcaggcctctgagtgggaaagggaaggaaacatatttttaattttaatagtctgcctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattctgtatctatgaaatggggatgattcctgtcacgctgttgctgtaaaaaacaaaatatagaaacacggaatgctgttcttggcatggagatttcaaactattgttcagtgaacacctactatgtgctgacatcccaatgctacttgaatcttcttattttcagcatttggtcagagctcatgtcccatttttaagatgatttgttctacaaaatcatagaatgtttgacttttaaagcttcttatagcccctcttgcccagtgatttttggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttgaaacagaagcttcaagtcttctccatccactgaaatgagttgttgaagtggaaaagtaagttctaattgaaccaccttctccgatgcagagaaaaagcagacttgaacaattgggttgatcttctatttctcaggttggagaagtgctttgaggaaagaaagatggggaatcaagatcagaggaatgcaaagttctggaatgtttgcctcagttgccctctactgggtctggcttggggaagtttgtagaactttttaatgagtcattgtaggttcaggagagatttcagatgtgggggacagggtgaaatgctttcttacacagaagtgaatgagttagtgaaactgtagcacgtacagtttgggagaatgggggcaatggggggattgtggtacgggagaaggagcaccagcctgggattcagacaggtctgagtttaaattccagctctggcacttgctaggtaggcagcgttggacaagttgggtaacctcagtttccaccttgagcaagtgcttgactaataacagctgtgactgttaccagtatggtaattacagtatcccaaggtgtaaagaagcagaagcatgattatatgagttgggtcaaagatttggctgtctccctgtccccccaccaatctggctacagggcagactttgctaaatagacacagatttacttccaatgaagtgggtttgctgcactgaataaagtagtttacttttccttcactgcagctgtgcttgaaattggacagaaagccaggtgtggtggctcacgcctgtaatcacagcactttgggaggctgaggcgggcggatcatgaggtcaggagattgagaccatcctggctaacatggtgaatccagcctgggcgacagagcatgactctgtctcaaaataaataaataataataaattggacagaaaataagatagagttgtagcaattagtctgcagtttttgactttattaaattcacttagacatgtggctgcaccattatgctaaggtacctgaggctctactatggtgtattcattgtcgaaaatgtgtttgcgatgtagatacttctttcacctagttctatagtgatactattgggaatctgaagttgtcaagcagctagtgtatataattgcatgtaaaatagactgtattttgtacttattgaaatctaatggtgatacttggttttagattactgaatgtagattctgaagaattatggccccagtaatgaatggatgtgtaattagaatttttatcattattctgtaacatctctgctgaaaatttcaggtttatataattgttttggcttggcttgaaacacaaattatacttaaagtaacagacagtaattgagaaaattatacttaaaggaacagacagtaattgaatccaataaaaacaccaaagaagatcaagattgctgtgagtggagagtctggcttgtatattttgcgaacctcatggcttgaatgacatattctcaacaaatgcatgccaagtaaagaaaatactgactttatgtttttgattcaaatattcatttcatgaaactccaaataacttttagtgatatggtagtttatgtgttgatccagtgttttaaattttaacaatatacagagaattcctaattacactggagattttgaaattttcaaaaaataaaattttgtataagctttaccctgtgagggaatcctcacttctggtctcaaatcagctagtgttgggcattgaaaatattcacagagattatgtattaattatatagttgtacttagaaatgtatatgagagttgttaatgacataggactcaatattcgtctccctcgttctcactctttgtatgcttaggaatgccaattacttcctcacattatcctgtaaagaggtataatcgatttagagataatgagagtgacctagggaaaaagttattaagccacaaatcaattacaccctatcaaccacaccctcacttgctctccccacctctcttccagcccccaaataccaagaccaaaagcttggaatcacttcatggaaagtcctttgaaaatgatttgtacactgataaaacttcttggaaacataaatcccttgactgatacttgttgagcaagttaaagatgtcccagttcacacctattgcaacagaaccagaaatcactgaaagaggctaagttgtacccgtaagtttggaatgcagagctgggtttctgtcctttgttattcaggatgtatttctttctttcttgggctcagtaagtagagtgtagtaacagtgtaatagcatttgtgttcccaccttcccacactataccccaccccccccaagccatggcatgagcttatatgttagagaaaaaagaaacagcttcggagaacctggccattcgagggccatgctgtctggtagcttctgtgttggcagtgaggatcattgatgtgggtgatgggcttatgcccaggcatgtgtgttcttcatccagcctaccctcctctgcggttctggtttagagtgtgttggtttggggcagtgtgatgatctttatgtggcccccagggccagcagcaggaggtgtctgccatgtcaggggagagtaatgaagtctggacaccatggaatgcctgtgtgcagcctctctgcgcttgtcctcatgaacttctccaacagtcttactgatttttttacaacaaaaattatacctaatgattatctatttcatgtacaaacacaaagaccattttactgttaggattgaaataaaactttttttgtcttcaaattgttttgctctaacacaggcgagatttttatttttaaagacaaggttaaaactctttttctctgcataatttcagtgtctagaatagagtaacagtcctgctttatatttgtataacgcttagcaccagtgctaacaaaatgcaacatgagactgggcatggtgattcatgcctgtaatcccagcactttgggaggccgaggcgggtggattgcctgaggtcaggagttcaagaccagcctggccaacatggtgaaaccccatctctactaaaaatacaaaaaattgctcaggtgtggtggcgggtgcctgtaatcccagctactcaggaggctgacatgggagaatcgcttgaacccaggaggcggaggttgtagtgagctgagattggaccactgcacttcagcctgggcaataggagtgagactttgtctcaaaaaatatgcaacatgccgggtgcagtggctcacgcctgtagtcccagcactttgggatgctgaggtgggcagatcacgaggtcaggagatcgagaccatcctggccaacatggcgaaaccctgtctctactaacaatacaaaaattagctgggcatggtggtgggtgcctgtaatcccagctacacaggaggctgaggcaggagaattgcttgaacccaggaggcggaggttgcggtgagccgagatcacaccactgtactccagcctgggtgacagagcaagactctgtctcaaatatttcaaatatatatatatatatatatatatatatatgcaacatgaactactatgtaatttaaaaattttactagccacctttaaaaattaagaagaaacagatggaaatgattttaccatgtattttatttaatctaatatctcaaaaatctattattccaacatagaagcaatataaaaattgttaatgaaatattttacgtttgttttttccactccgagtctttggaatggcatgtgtgctttacactgacggtgcctctcacttcaggccggccctgtgtccagtgcggtctccataaaggactctggtgtccagaagttcccatggccgctccattccgtacttggttttcacaaaaactgtctcctaccttctaatgtcctcaattctacaggaaaatgagaatcatctccagacagtagaaactgtatccataatccatattatgaagagataaaatagccaattgtactttgtttttttttttgttgttgtttttcttgagacagaattttcctctgttgcccaggtcggagtgcagcagtgcgatctcggctcacagcaacccctgccttccagggtttaagcgatccttctgcctcagcctccctagtagctgggaccacaggcatgtgccaccatggccagctaattttttgtacttttagtaaagacagggtttcaccatgttggccaggctggtctcgaactcctggcctcaggtgatccgcctgcctcaacctcccaacgtgctgggattacaggcgtgagccactgtgcccggcccctattgtacttctgtttgaacttatattggcaaatgtagtaattttctagagttttagaggaggtagtgtttattattataaatatttgctgagaactttctgagcaaagggtactatttattctatataaatatgtactgagcatctgctagttatttaacagacttctaggcacaaaggatccaatggaaaaaataagaatattcatatttaacagcttctttgtgctctaggcattgattattctctgcattgatagaatttacacttgcagctttcaccaaagaaaatgttccacagtttaggcagcatggcaaaaatccatctctacaaaaaaataccaaaattagcaggtggtgcatgcctgtagtcccagctactcaagaggctgaggtgggaggatcgcttaagcccaaaagatcgaggctgcagtgagctgtgattgtgccactgtgctctagcctaggtgacagagccagaccctgtctttaaaaaaaaaaaaagaaaaaatgctataattttacaaaacctgctctccatgtatccctctctactctccttaagatgaacactgggtctggggtgcaggggtgccacagctggagttgaagaggaagttaggagaaggctaggaaccatcacggagatttttcaccctggttccttcattattacttgttggggatcagtgaagattagaaattgatgatggcggccaggcgcggtcgctcacgtctgtaatcccagcacctttgggaggctgaggcgggcggatcacaaggtcaggagttcaagaacagcctagccaatatggtgaaaccccgtctctactaaaaatacaaaaaaaattagccgggcatagtggcgggtgcctgtaatcccagctacacaggaggctgaggcaggaggatcgcttgaacccagaaggcggaggttgcagtgagctaagattgcgccactgcactccagcctgggtgacagagcaagactctgtctcaaaaaaaaaaaaaaaaaaaaagaggaagaaattgaacatggctttacagaggagcttctcttccctgcaggtagcggccttagacccttgtctaaggcaaaagtgggatttagggaaagatactgtggtagctgacacagaattgcaaaaggctgaaaacccccgccagcgaagggcagcagctgctcccctcctgtgggcactctattgccctcatagagagaaggcatctcccagcactttctacaaccacacccccaacccccaacccccaacccccagcttagttctctagaagagcagaccctcaccctcccccacctcctcagcccagcctggaaaggcccacggaaggactctgccagccctggctaaagttatgtgtccacctctagagcagccacctggcctggggacgaagcagtatgagcccacattctgagttgtaaaaccccacaattaggaaatagacttaaagtgctcccatcacattaggatgcaatgtgcatttttgtttgtagaagcttgttctccatttcttcttatttgggcaaaataagctcagtttgactaactctgccatctctaacccagaccccaccatgctctgacactttgacaagcacactggatgggcaaaagagtcaactaccgaaggaagacaattttcgtttggtctaaaactttatacctgtgatattctgtgccatggagagactcgtgcttaataattcactttccaatgatcttaggcaatgtagaagattacaaatactgtgagacctgaactcctccttcagggaacttaacagttttcagtggcgggggaaataagagtagattcctgaaaccatagcagcatccgatagaacagaacatttcctcgactctagcaaatctcttaattccaggtgtactcgggaagatagtagcatttattgggtatatactatgaagagagaagtgtcatatcctgagagggggtttataggcagtaaacattgtagtctttgccttcaaggtgtttgaaacataaaacatgctcacattagctaaatatgcctgcttcaatgcctgtacttatatcacacaaccgacgttatcaacctggtttcaaacgccatgagcaaaaatcaaatcaggtaatgtgtgtgaaagttcattatgactgtaccaccatacaaaccgagatggtattactccagtcagaccttctgttttatagtgtgttccagaagctggcctggttgcagaagagagtgagctcattagccctgttcaaaaaaaaaaataaatggaataataaagaaacttcaaaaccaaatgaaataccattccatgcacatcttggaaaagtttataacgtatttaaacatgaagagctattgtaagcttgacaataaaactgtgaggatattgttcatttccgagattcacttttccaagatagctctatcgtgaaagtctcttttggagtttatgtatagttctttaaattggcacagttggcttaaagctaaaacactgtagtttgcattaaaaaagaaaaaaaaaaagcaagtgcttttgcacaaaaggctgtaagaaatgagggctgcatatgaagcgagtgttccgttgactgtgtgagtgtgagatccttttggctttagtcatttatttggggcaagctccgaccttgatgacagatgatttcgtcaagctctccacaaaaggtacatgtctattttcatcgtcaactaacttctgtggagcacttgctgcttttggtcccctaaccatgaggttttattgacccatttgccatctctggggtaagtggatggaatcatctttcttgagaggagaactccaggaataatattacacttgtctctgagccatttgagcttgctatttttacagatttcagccttagttccttttcctcttcctctgtcaccctcagaacactgggacaagggggagccatgctgtttcataaacttcccatagaggttctgagtctcctttttagctgattcccatgagtttgtaatattttgatctgagctggttgcagtttgaaataaataaaagcaatctgatttcattctagccaacatctgatgggtttgatatggatgaaagctaatgagaggtacaagtgagacagtacaggtgaaaactacaaaatctctcttgtaaaatacacatatacgcagacccatattttccaatgacacttaaaaggagtgataccaagaggaaacactgagtcccatgaaacatttcttcaatcaggacagaaccatgagcagaggacatagtgggtggggttcgtggaaaaatagaatatatatctaattttctgtttgatgatggtctacggattgatttaattatgattactacagtaacttgcctagtacttcctgttcacggttgccttttacatgcacagcaggttgcttggggagctgatgtctgctcctagcctttctgctccggtaccctttgttctgttccattatgtttcagataatttaatcaaagttgtgtttgcttgtgcgctcccccctttgaatcattctcactgcacttctgccccttccatgcagatgcaggctgatgccggatgggtctccactggcctcttctctggacttctctggggcccgtatcagaacccaaaacctagcctcagcttgacttcttcctcttaccacggggtgaccccggtgtgatctcccctcccaggttccatccagcatgaccgccgggtctccctctgccctacttgattgcactcaccttttgttaccagtccaggcagcaggctccatgtctgggttgggggtgtttcctggcctgacggggcaccttgttcgtttcacccaggcaggaaatcacgtcttgtttcaacatcctgaatcttgtcctgacgtggaaaccgtgatgctagctgacctgacctgcagcctcaggcatccctcggccctttcatggcctggtgtttatgtggtccgtcctcacaaactcttaggatgggatttattgtctccattttcttttctttctttctttcttctttccttttgttattttttttttttttttgagtcttgctctgttgcccctggatggagtgcaatggcaccatcttggctcactgcaacctctgcctcctgggttgaagcggttctcctgcctcactcagcctcccgagtagctgggactacagatgtgtaccaccatgcttggctaatttttttatatttttagtagagacaaggttttaccatattagccaggctggtctcgaattcctgacctcaagtgattctcccaccttggcctcccaaaatgctgggattacagatatgagccaccgtgcctggcctacagtctccattttctataggaaatgaaagcttagtgagagaaggtgcccagacccccaatggctgcgaatcggcagagttgggccccagtgggtctcctcactccatcccccttgtaccacccagtgtctcaccagccattctgctcagatgggatgtagggcctatatagcaaatagaagttttctgggaaccccttaatgacaaaaaatacttgctttccagagtattcatggcaggccttgataatcttgagcctcaagtgcccacaattccttctgggactgactttaaacctttatttcaaatacaagctgggtcttcattattctttgttgcaatggatctctttacacgttaccctcagaaccacaaattagcaagagtctagctggaatctctcctgtgatggaaatttcattccctaagaaatagagcaacctttcttaattaggcatttactctaatgattcagaaagttggttctttatttttgctttattttcattagaaactaaagatttggatggtgttttcataatctattgagaactgcaccaagactgtcagtattcaatacatatgattaataatcagagggaagacacttatattttctgtcatacacacatacctaaatgtttaggccaagggcacatttttaattgattcaaatagcaaatataaattgtgcctctctgttacctgaatgtcttacttttttggaggttttgttgtcaggaactgccatataagaggcatgcatcattttaattgaatcttaaacctgacacttttattgaccaaaaaaaaggatttcaagttatttttcatgcataaagcctgcatgaagcctgtacttctttagtgaaggctatctcagatatgtatgaccttacctccttgcctttaggaaaaattaaacctcactgtctgagatccttgagatttggcaaatgttgatcaattaactcttcaaagacttatgatgaaataactgtaggcaataaaacatactgaaatatgtccaaatgaccagcacagcaaaatatgcatgaccctgtgcctaaggtctgtggcatacaagccttgggttctgtttatggggatgtcaccttctatgactcaggtccctgtctagaaacatgatatggccacgtcttggtggttccttatttatgcggtcgagtcttttgtattcttaagtcatctctggaggataaaagtcagagctcaaagtctatatatactgtcacaaaacaaggatgcagatataatgatgataaaattgaacctatgatttaagaaatgcgatatgaatatgatatgacaactctacctgccaccagtggactaatttcccttgttgccaggggagacctcatcctcatcctaatttacacagtgttgtatgtttgtcaagaatgcataattctgccagtctgttgtatttctaattttagcctgtatacatagaaacactttaaaacatttgcaggctactgcaatcatcgtcatacaatctgtatagttgttacatagaaataatatcagttggtttccccataataattttttctagagagctagctgttcaatgctaattcatatcctttcttaaggtatatggcaagtaaaatggatttcctcggggcctggaaggaattcctgttcaatgattggaacatttaaaagatttcctcttgatttcctacaaggaaggaataggaaagggaggtgattggtcttgttagcctggaaatagtattcactgggtcgctagagggtgggcagagagggacgcaaaaaggcgtgtgtcagagttcctgtctccggggaggtcacaggatcgttagacagataagagagacgcctgtgtctaggtgtctttggttcagtcctaatgttctgcttggtgtctggttcccacaggtcatttggggggtctgaatggtgatggatacctctcagagaaaaaaaagatttaggcttccaggcaaagtggagaatgaagagtaaagacttggaatgatgggtggcaggataaaatagaagaatcattagttattagaattattagggtaaaaagccgtgttaagtgctttgtaggtaggaggaccgtatatcccaatttgcttaggccagtcctggtttatggcaattgccctgacttgagttttagtaacattcccttttattctcaatagcgtcccagtttgggcaataagtcatatggtcaacatatatattgatgaagaattaggatcttaatataggaacagattgcgagtgaagataaaggtaaaatcaattttgaagtccccttatactacaccgtaatttgatatctatatcaatctctaattttacttgaggagtagtgttgacctcatgtcttagaagaaaaaaatgaaggtaaaaaaataataaaattttgcttaggccgttgtgaaatttcctttcaaagacggaactagaatttagaactcaaaaacctcatttcctatactaacccccaccctacattgccggggaaaatggaaaaagcaaaagaaataatgggatataaaaatgtatgggacacattctttcctctattatgagcttgtctcttaattaccaccatttatactggacatgtgatttgggtttccagaatagtaaaaacacagatattataagccctgtgatcatttgcaaagaaatctcatttgcccaggctattacatttctgttctgccttcagtggaaatacacatagaatggaatagaaatatgcattactatgagtaattccagacaccttaatgcttttagcgggagtgcatttggagtttgtttcctgagacccctctggtggaggtggttgttattcatgcttgctggaacagtcctccccacgtctgtgagctcaagcaggtcctggcctcagaaccacagaactccaatagccagagactaaaagaaaagggaaaaatggtttgctcggatccctgggttgcttggcccacaccctgagtgtaatatgtgatcagggttagaaagcaagtggtgggagcaggtcttgcttctgtgggcatggcctcctagagaaatagtccagcgctggaggcacagagaggggaggacaggcattccaaggctcttgaagaactgaaatctggaatcgacatgaagctacatcccgaagcagggaagtaacgacgggcctggaagggattcctgttcaattagtggaatatttacagaagtgttgttttgaagatgaatttatggatgatgttcatgtaaagtgagatagaatgaggggacagacagggatagggaagcaattaatttgccatagatgtgggtctgaaaataatctttactggcttgcctggtgttgtctaaagtagcaggggaagctttgagaatcctattgatttcaggttactatccaggaactataaaatattaaagcagaaaggagacttagtgatcattaaattcattctgaaatgagaaaaatcaagcccacagaaatggagggtttacttaatggagggtgtacatggtattaggggcaggaaccaggtctagaacacacccactggctccttgtcattaaccccgttgccctggagagaagagaagccggtggtcacactttgacagacacagtgtgggtgatgccagagccaaaaccttgggaagggaactgtgtggcttcatggacatgaccagatccacagtcatccactgggttactgtcttcccagttctcatcagccagggttgtttagaaacattgaaaaatgttgctaactgtggatagctctgtaagtagggttttccatctttctaacacttattacatttttttattcctggaacaattttgaatgagaagtggaaaccatggttttagccctacttatctcttaaggaagaatagattggaacagtacaggtgttttgcttaagtttgtggatttacttaaatattccctatgaaagctccggtgtacacatttattttattcatgatttcaacaaagctttactgtgcaccacatacagtccagcatggtcccatagagctttcagcaatggtggaattgtgttgcatccgcactggccagcgttgcagccactagccacatgttgctgtcgcagtcttaaaatgtggctggtgatcagggacgatgagcttttctcatatatctgttggctgcataaatgtcttcttttgcgaagtgtctgttcatatccgtcacccactttttgattggcttatttgttattagagaaatgcaagtgaaaaccacaaggagatactatctcacgccagttagaatggcgatcattaaaaagtcaggacacaacagatgctggagaggatgtggagaaataggaacgctttcacactgttggggggagtgtaaattagtttaatcatggaagacagtgtggtgattcctcaagggcctagaaccagaaataccatttgacccagcaatcccattactgggtatatacccaaaggattataaatcattctataaggacacttgcacacatatgtttcttgcagcactatttacaataacaaagacttggaaccaacccaaatgcccatcaatgatagactgaataaagaaaatgtggcacatatacaccatggaatactatgcagccataaaaaagaatgagttcatgtcctttgcagagaaatggatgaagctggaaaccatcattctcagcaaactaacacaggaacagaaaaccaaacactgcatgttctcactcacaagcgggagttgaacaatgagaacacatggacgacacagggaggggaacatcacacactggggcctgtcgggcggtggaggggaaggggagggagaccattaggacaaatacctaatgcatgcagggcttaaaacctagatgatgggttgataggtgcagcaaaccaccatggcacatgtatacctatgtaacaaacctgcacgttgtgcacatgtatcccagaacttaaagtaaaaatttttaaacatgtggctggtgactgagagatgcaattcttaactgtagttagttctaattaattgaaattgagatcaccacagatggcagaggctttcatgtcagtttcagactctggtattgggtcgagggagaaaagaaaaaagacaagtcatgatctctgaggacaaggtattcacagccgagagtggcagggatgaggagagacaggtaaacaattgtcacactggagtgtggccagttatgtcactgtgggaataaggtcctgtgagagcacggaaaagatgagcgtgatatgattcctctttggggcgggcaagcatcagggcagtttgacaaagagcagatgttcctgtctttacgaacggactgagaccgctccagacatctgagatgaacatgaagagaaaggaattttcaacaatggagcaaacatacattctcagcagtgtaaagagcagagcgccagaggcaaccgtgtacttctggtgtacttctgcgtgcacgttggtgtacacaccctctggggaggtgaactagcaggcagcttggcaagaagtcgcctgcggtgttctgcgtctcagcccttgttcaccatagtgctctgtgtgaagttggacaaatgcatctacctttctggacttcagtctcctctccactccccgaaggcagggcagagcagctgtatgactccttctcagatctgggcttagtccttacaagcttctgttgcattctccagctcctgcagtggccttccctcaagacaatgagaagcttcttggcctcctctttaacactgggtgctatttaatgagggcacctcaagatcctcccagttaccacgattgctggtggcagtcatctcccctccgacaacagttttgtgctctgagtgcctgtgctgtttccacatttttttctccccctcaggtattttagaccccaaagatacatgggtactctagggatactgtgtaaagactgggtagtatttggaactggcagccagagagacgacattggcaattcattcatctatcattacctcaattggcagtgttctcagtacgcagggactgtctctgtgtggctttttgtgagagggatgtaagatttatttttctctatgacctacctgctggcatggtacaaaaggtctctgccgaggtctgagggacctcacttgagctgcactaatagacggggggataactggtagaccaggagagtgtagacaggaagaaagaactcacctttgtaaatgagccactcaggcttttgattttgtggcccttgaattcccacttcagctgatggtcacactcatctgtggggaagctaattttacaagaaatggaacaggagggggttgctgttggatcaagaagatgcagctttggaaggtatccacgagggaatagccatcaatttgccacgtgtgtgagctctaccatcccgcagcacatgggagcgtgctgtgctgtgcctgtgtgctctcaaggtagacgaggtgtcactatatggtcatccacacagcaggtgtggccaaatatagagatctcgtgaaaaactaatagcctgccaaagaatacagccactttttcagggtcgtaaaaacactctgtgactttcccaaaatacagttactatacatgcactagcaaatcccaggatgttctcttcttatggtgcacatagctaaatacccacctgtggaatgtgggtttatttgggaagaagctaatcctattaggagtttcatattctcaccaatttgggtgatggggtctgtgaccaaagatcatagaaagtaagaaatacaggactcaaaaatgtgttcttcattatgtcttcacctcgtgctttttaaacttttttttttttttttgagacagagtctcactctgtcactcaggctggagtgcagtggtgcaatcccagctcactgcaacctccgtctcctgggttcaagtgattctcctgcctcagcttcctgagtagctgggattacaggcacatgccaccacgcccggctaatttgtgtatttttagtagggacagggtttcaccatgttggccaggctggtctcaaactcctggcctcaggtgatccacccgcctcagcctcccaaagtgctgggattacaagcgtgagccaccacacccggccatggttttcaaactttaatgtgcatggaaattactggaagtgtttgttaaagtacagatgctgcttcagctggttgggcataggtcctgagatcccgcgtctctcacgggctcccaggccatgcagttgatgttggtccatggatgaccctctgggtagcaacgtttggggtctttgtgtgtccacacatggtgtgtctgtccattaggaggaaagtgccagcgcatttgccaaagcgtttagataggagcctgttagagtttgaagttccaggaccaaggaaatctggtaaataaaggacagttgtttgttcatggatctaggtttataaagtgtgtatacattttgagattctgtctcccccctccaaccttaaaattagcaaaatgtagtctttctttgtcgagctctaggaataatttttctgcgtcagatgcatttttgggaaggtgcgtttggccatttcccactcaccgtgcccgcccagtatccctgcagtactttggaagcaccataattgggaaagagtagaaagttcttgccttggaaatgagattcttatctgggtcttgggcactggaggatctcaggcgcgggaggctcgcgatgggtccggggaacagctgctgtgttcctgtaggaggaaatgcctgtgatggaggcttctaaagccagctcccgtctcagagaagacagctctatgcctccacgtcgtgatagcaaatgttcccttttggctgttttaatagttctgcttcaagcgtatttgtttttccttatttcctagcatctttgagaaagatctgttctatactctgtagcccagtttggagagatatgacatgtttgactatgtgaggaaatatacatatttctcagggcttttttttttaaattgagtgttattggactttgatgtttgatttccaggcagtctttaatgtgaaaggcaaacacattcattttctatcagttcctgaaaatgttcccaattttagaagctctagactggtcttgccaatatagcaacatagtgacagttactcgtctgtaattctgtacttaaatcgtgaactgctagcactatcgattaatgctttatacagtttcaaagctgtactcccaggctgcatttagatggtttaaagcattgatttctctctctgacaactcttaagttattggctgccaaaaaaatgaggaaaggttggttaatctccatggctcatatgttgcttgctgtagagaatattggtgaagcatagtttttcttcattgtaagatgcactagggatgtgaagactgttttgaatcattgtgaaaactggaatcagaaaaacaatctcctcattcaattcaagaattcgagatccaaaacaacattcagtttggtatttggcagtttaaccaatatctgactttatgtaattttaattattggggtcagccattggtattgcattataatttgtaatgatttatatcagccttttaaaaatgctcacagtcatggacaaaactggaaaaaatgaggaagtaacccaatccaaattacttaatatcatctgctgtaattagaaattagattttagtagactgtttccataatacatttcagaattatttttataacttaatagtataaatacaaaataatttcagctttgttattttattatgtgctgtgctagtttaaattattccggttataggtgtatcatcaacaccttatcttcagcaaggattttaaatatgggctgaccaaatttatgtggaatttgcattttgttattcgtttaaaaacatacagaaaatggaaaaaaaaaaaaaaacctttgcaaagattctcttttgagtgctagcttttcctgatccctaaggatgccggctgctctgccaggaatgtgcccttcatattatatcttctagaatgaatgtttggaagggaaagcagtaagatgcaaaagcaagaaggacagatgatgttcatactcacagtaatagctgtctcccctcttatcagttgtgatgctggaacaaacacctctttcctgactgcagggtttggaggtccccaagtccaccctcacttctgccatcaatggcaagcggcactggctgcgtggaaaagccaagatgcctttcaccataccatgtctggagtctagttgctgctcaataaaccctggtggcgatcactctcgagattcagtaacattatccagaatttaaaaaaaatacaagcctgggcacagtggctcacgcctgtaatcccagcactttgggaggccgcggtggcagatcacttgaggtcagaagttcgagatcagtctggctaacatagtgaaaccccatctctactaaaaatacaaaaaatagccaggcatggtggcacgcacctgtagtcccagctactcaggaggctgaggtgggcgaatcgcttgaagctggtaggcagaggttacagtgagccaagattgtaccactgcactcagacctgagcaacagaggaagactctgtctcaaaagaaaaggaacagaaaaaaaaaatacaacaatgtgtggtccttgtattcaagccaagcttatttctgcctcaaagcattgtgccaagtttgtatgttacttcaggtttcataagccagcagatcctcttcctgggactgaaatgatgatttcagttttttcaatgcttaagcgtggaaaacaggcaggtaatttgtgacccataagggaggggtgagaaccacatgaagatgaaggtggtggaaaggagcagctgatgtcacgcactgtctacttaacattgccacgttaatgttaatgccggttatagaaagcaatgggtaattgccatatttttgttacggcttattgcagtgaatgcaggatgcttctcacatctcttacacatcaagtaagagtatttcttaaaaaacaaaacaaaacaaaacaaaacaaactctcaatgccacatatacctgaattgtgagtacttatttcacctaacaaatacctaacaaatattgatattttgccacttatgggttgtataaatgaccattaatatgatttgtcaggcacagtacacacaactaacctataaacaatgtgcagacgtaggtcataaactgtgacactcgaaatccaagtagtgcccctggtgggagatgtttcacatgttaataagcaattaccgtagtagattaagagtacagaatcaatccaagaagccaataatttagagttggatactgtagcacaagattgcaggaacctgagtgctgtgtgccacgctgcacatcagaggttgcaagatgtcctgcaatgcaggctcaggaaagtgactgatgcgctgtgttctaatgtggaattctacaggtattcgtggaaaaacatcaatacattagcaaaacctggaccgtttctggtgttgctggtgctgcatgggatgagtctgtggggcactccatgggatatatttaaagaggtgttattttgtctcaagcggctagggcggagatagagcatgctatttgccacattgcattctaggggttgcaagacatcctgaaatgtgggctccatgaaagcggttcatgctgtgatctgtacccccagatctcttcccaggcaggtctcatccaccaccagaaatggtccatgttttactactgtattgatgtttttccacaaatacctgtagaaatccatattagaacacagggcgtcagtcactttcctgagcctgcattccaggacatcttgcagcctctgaaatgcagcgtggcacacagcactcaggttcctgcaatcagcatgcccacatggtcataatacagacttagcaacctggaaggaagtctcagtgatctgtgacccagccctttctcctgatagaccgtggaactgcaggcagaagatgcacggcgtctcatctcagatacacagtggtggtgccgggatggtatgtgctctccattctccctggagggctcttggtccatcttgcttcagtgactagcatgagaggagtggtgatagcagcaggtgccgtggccactgggcaggcggggtatggagaacgcagccacacggccgccactcctgctatggaggcaccaggtcccgcaacactggtaccataggacagggcttcctggtatcacaggatttgccagagctggaacgtaacgcccacttcacaccttggagtatgattcaaagtagagtttgtagtgaattccaaaaggcatgtgattcaagctaactgccaagaccattcagagttgtggggagaaaaccccactgtgggcacgtgagtcagggaagcagcatggaagcggcttgggtaggattgtggcaactggaagggagttgggcgggccatggttacagatgcgggaagtggtcggagtggggaagaggacctgtctgattcccaggaagtgggcaggctccatgcagagcaggatcccccgtggagcctacacagccttgcacacctgaactgaggggcaacgaagaaggggtctttgtagttcccttggttaggcaagtcaccagctggaagtggcagccgagacccggcagggacaaccctgtctttcccagtgagcatctgatgatattatccggggcccgagcagctagggtagaaaaggagaagcatttaaacatcagtgcctcaaatctcctttccaaacatcccaggtatagaaagttacatcactcttgcaatttggttcatcaattgtcctcactgcaaagttgaacctaaactaactcctgttgggaggcagactagggacaagtgactttcagtgatgctgaactgtgaggctgaggcactggccatactgcctcccaaatggaaccctcgtttgtgcaaatgcccccggccagggtggtacccacacacatctgcacatgactttctcagtctcctcctaaattatccctattctttttgaaaacataaaattaacccaggtggaagtttgtgttgtaaaacatggagtagttttcaatattgtaataggctcttcaagaagagcagcatttgcccacaatctgaatttttagaaaacgtctaaaatctcgagttatcagcaggacgatatccacacagtagatacatccctaccggactcagtggcaaattatgacacaggccaaggtctatccttgcaccatctgtcatttctgagtcttcaaagagctcagagatgtcctctgtgtgcctccttacccaggcaggcagcctaaactcccagggttcttcccaggcagatctcagccatcctgggctcaggaaggcattccaggaaaccagaacgcaagggataaaagatggaggaagtcacctcttttagcagagtttgcactttgatgagaatgaaggctcacgcccagggagaaggtggataagagagacgtttaagcaccagctctaaggtagttgcagtttgctgggctgatttgggtgctcctgaaggatttgttgtctggggactcttgcctggtgcccaaggctgtaccttcttgcgcgtaagcctgttcagctctcggcccgtgtggcatgcaggccacaggagaaggtgactccagcccctcctccgttgactgcatttctcactgagcgtatatctgtcttgccttctcgcagattgttttcacgtggcatttcacttaactttagtctggattcacattttttttttccagaaggtgagattcttcttcaccaagatgtcacagtttgggcaaagttcaaagttgcttaaatttcttcgaagggctccatgagcagttgtactccagcaggactgtcactccaaattggactctccagctggtcaggggcggctttccaagaatcttgatgtcccagagcccctctgatacagtatctgaaaggccttttttgaatgtttggaatgctcttgtctgagagatatcttaatatgaaagcaaatacctgaagcataataaaagcttgtaaagcatcaagaaaagaaacgatctcaggaaaacctaatagtaactcgtgatccagggacatataaaactggagatacaccgtgaaataaaaaatgtcaggtacttaacagcatgcaaatgactgaagccaaaagaaaaagaaagaaaagaagaagaaccaattaactatgagagtctgcatccttccccagggccagtgttaatttccatcgctgtctttaagcacatcgttttgaaagagtgtgctcgggttcatccatcttatttcttctgttagcctcagaaagggagaaagtaattttcctacattgtcagcttctttacaaatgtctgggccttttctaaacagaacccccattgaatagaggaaaacaaccattctcacactgaatgccctctttaaccctaaatgcttattcagtcatttagcacctctcttcctcgccttttttcccttctgaacatgacctgaaagaagatgttggaacccccctgcatggcggcgggtggcattgccctgccccattcatctgcgcgttcatccgtttctcttacggagcagcctcaatgctctaccgatgtgcgggtgccaatctgtctccccgaggttattcagcatctaacgttgctatttaatctccagatttctaaacttgcagcagactggctgtgaacaggccagattatttgtttcctcttaaaataagtgcttgatggttgggttgtgtggggccggtccttggtggtcactgcatgtaatcaacattcatagactgtaggaaaatgtggtttaatgaaacattctgccactttttcttctttggcacgcgttaagcagtgcgtgcaatgcattgcaaatgcaagtaattcagagtttacaaggaaaggaaggagagtgaggaaccccagaggacagggacgtggggtggtgggacagggcttcaggctgatttatctttcatacagtagtttggccagtgggaacgcggagtgggaggaggctgtggctgcctgctcttcccaatggggaggaggctttacggtcctctcagcggagctggtgtttactaaaaggtctttcctaaagagcccaccgaatagaaaacgtctacttcccgtaggctcctgagaagcttcctgaagtcagtgagcacgttctgcataaaagctcatttgaactctgcactaatttgcctagcaattcataggaatcaatcatctaatattcagtccccatctaatgaatggctgcttaaacacactagtttttttttttcattgcattgggttaggaagtttgcagctggtaaattaaaataggaagcagtctttggtatgaaagtggcatattttaagtgccttggaatgcacttgttacaagtgctctgctgttatgtgagcagtagtttaatgtggttggctgggcgtagtggctcacgcctgtaatcccagcactttgggagcctgagatgggcggatcacgaggtcaggagttcaaaaccagcctggccaacatggagaaaccccgtctctactaaaaatacaaaaattagctgggcatgggtgcacacgcctgtaattccagctactcgggaggctgaggcaagagaattgcttgaacctaggaggcagagtttgcagtgagccaagattgcgccactgcactccagcctgggtgacagagcaagactccacctcgcaaagaaaaaaaaaattaatgtggttgaccattagaaacacaacatcaaaattgttttggagccatcttagttggttaagattgatgtgcaaaaatcaaatatttggcagttataaaaggacataccatagattttaactaatctcttttatgtagagagtggcaaaaaatcttaatgctttaatgaaacctactttacaatcacgaatgttatttgtattctgtgaacatattgcaatgtacaagcagctgaacaatgaaataaatccaaaatccccaaacacttcccagtcagctcagcctcacaggtgtccattgggtccttggttctttgcttcctctccatccccagctttcagcacattgctgtgtggccgtcttgaaggaaagcccttcattctcttcaccttcgctcaggtttcctggctcactggctatggtgaataatttatccctctgattttaatgagtgtattttattgtgtttttaaaaagtagggacccaaactgatcttcatgctatctctttgtttaaaactatatttgaaaaaaatacttccattaattttttagatattgaatccagaagcactggtgatagcagcaataactaacatgtgtttttcatgaataggtggcaattattgcaaaaaaatgctttacatacgttattgcaattaatacagccaccaccttagtcgctgttattatacctaccttgccccagaacagtgaggcttgagcagctaaaaccacttgcttgaggtcttctaggcagggagtaccatgaaacccgtgtccactacagaatgcctggcgctgctctttttggctctgagtgtgcttacgattttttgaaaaacatttcccttgagacatccttttcttatagtatttgtagttttttcagcatatataaatatataaattgaattattataacataaacttataaattacattctctaatgaatggattcaaggctcctggcagagatactagtttttatgcttgtaatcaatcacacttaaatatcatgcaatccaaatgctaacaaaattactctgtccccatttggcatttagaaaacatcaaaaacatgctgatgatgccaaatagggtttttaagaatggggcgaaaggtgaaggtgtcaagtgcagcgaggattcctgcagctctttccttgtgtgggggtatgtcagcgtcagtgcaggctgcggtgtctggctctgtccttctgacatctgcggtggctgtggtccacctggagaggtggttatgtaggactcagggaaatacataattgtgagcattccatttattcaggttttagaaatgaaatctacaatcgcatgtgcctttctcatactctgtagtcgcagatctgatgagaaaagtgagagacagaacagagaaaaccctcactcctgggtcgggctttacttcttgactgtccaaaaaaggaaagatataagattttgattctttcttggaagctgcatcattactttgctttattgttcaagaaattgaataataggattatataataataatatgtaataataatcctattattcaatttcttgtcccttctgtttagtcttggggtgtgtatgcatgtgtgtacgtgtgtttgtgtttcacttttctccttgatgacatttaagactgcacccatttttatgttccaggtgttgtagatcttgtcaaaatggctgtctgttccttggttaccttctcctataatgacgcaagaagaatggttgaatttaaaaggcaatacatttagaaccaattaaagagaacatttttagcacagggtgtggcgcttacaagagttcataaaaaccgaagttgctgggaatgagttgccattcacctgcactagaaactatggacttgtgtcaacgatgggtcctttggggaggaaatcatctcatcacctgtgattcttttcttgttatcagagggagaaaatgttggcacagcttccctctagaaaaagatattgttaataattggttaattatgaagactgatgaagaaaagacattacagctgagatggttgggagggagagaatgtctaggctgtgaagcaaaaggaactaatgattagccagcagggtctgacaaccaggttacggtcagcagccccaggatatctgatcgtgtgggcacagcatggaaaggaatgcctctgaattggcctactaagctgaggcagaacaggcagacacactgggatttgagccggggatagggtgtggtcaggtggagagacagaactgaggccttcacatgtttgggggttctaggagggacagattctgtccagcctaccttttctcaatgcattaaactttggcaaagtaatcaggttgcagaagcaacattagagtatcctcctttagctgctgagttgggggtgaagtgggctgtaagccccggggcagttttcagaggacaggctttgagactgcctgaaagattcatcaccttaaggataaatttcctggaggcgaactagaagatcctgtgcattaacagaacagtcaatgcctgttatccaggaactgatgtgaacatctgacagcttctgtacctttcaatcttcaagcactgcatggtgaattttgtgatttaaggaaaccataaatgaattagatcacttttttccttccaaatgcgagattccaaatgacagcagaatttccgtccacttcctaaaagttaaaggtagaactgcttgagtgaggctaccagtgctgaactggcaagccaatcgtggccaaagctctcaaggtaaactgaaatgatcaatgtatttatagtaggataatcaaaatttatttattaaagaaaccaagatgagaccaagagcatccagtggccaatattgatgtgcctcacttgaaggcatttcaaaccatctcgccgctaaccaaggtacagcaagattgttcagctttgctgaaaatgacttgaccgtagatttgcttctggggcaaatggattgtaaattgctaaaatgacactggtttgaatggcctgaaaagaggaagggaactgctgcttccgtgttccctgagtgccttgtgtcattacctcatttactcactgcaacgccacacactttgtggcttcctgattttacagatgagaaaaccaagattctgaaggagtatgcagattccccaaaggcacacagctaatcagcggtggagcgaaattccaaacagctccaaagactgcctgtctccaaggggcatctcactgcatcttcgcaagtgcacaggcagcgtcagtccgggcactgaaactgacagctgctgcggtcttgattttgagacagtttgggtctcagccagtgctattcagcggcttgaagtccaaaatcacacccgtgcacatgtaggattgttgtctcacgtatcagtggacctgtcccctgcagggaagagttgataaatatggcactctgcttcacttttcttgtttttgttttagtttttgtttttgaaacagagtctttctctgtcaccctggctggagtgcaatggtgcgatctcggctcactgcaccctctgcctcctgggttcaggcgattctccggcctcagcctcctgagcaggtgggattacaggcgtgtgccaccatgcctagctaatttttgtattattagtacagatggggtttcaccatgttggccaggctggtatcgaaatcctgacctcaagtgatcctcccgccttggcctcccacagtgctgggattacaggcgtgtgccaccatgcctggctaatttttgtattattagtagagacggggtttcaccgtgttggccaggctggtatcgaaatcctgacctcaagtgatccgccagcctcagcctccgaaagtgctcggattataggcgtgagccaccgtgccccaccctctgcttcacttttctactctaagttcttttaaaagaaccatgacatggcagaagaagagactgatgaaaggtaggcaggaggggcactgccctgtctttggtcccaagccttttcctctcttatctgcagtcattcctgttaaggttatttccttgggaaaattccacacccacaattgtctgttcccaagcacaccctcacgtctgtgttctaacacccgcttcttacctactttctctcaataacaataaggtaagaagtaaattttctaactggcagacaggcgtatgaaaaggtgctaaacatcattgctcatcagagaaatgcaaatcaaaactgcaatgaggtatcatctcaccccagctaaaatggcttatatccaaaagacaagcagtaacaaatgctggcgaggatgtggagaaaagggaaccctcatacgctgttggtgggaaggtaaattagcacagccactatggagagtagtatggaggttccttaacaaactgaaaattgagctaccagggaaaggttttaacaagagtactgctaccagctgtaccagcctgcgatacatgctaaggactcaggtgctacgtgagagagatccagttaaaaccccagcttcaagatttaggggctgtggaagcttgtacgagtttcttggcaactctgattcacattttccggtgagacccccatctctactaaaaatacaaaaaattagctgggcgtcttggtgcacacctgtagtcccaactactcgggaggctgaggcaggagaattgcttgaacccaggaggcggaggttgcagtgagctgagatcatgtcactgcactccagcctgggtgacagagtgaaactccatctcaacaaaaaataaaagatgaataataacctccaagtgctgttgtggggattaaatatgagaatatgtttaaatgcttaatagctggcacttaaacataagtggaaaaagtgatcatgtgaccgctcggcaaatatcgctggtaccgttagttggtttgggctgctataccaagataccatagactaggtggctcaaacaacagacatttatttcctgaagtttcctgaagttctagaggctgaaagtcgaggatgagggtgcgggcagctttggtgtctggtgagggctctcttcttggtctccacaccgggcaggaggggagagagagtggaaagaggctctcacctgtctcttctcgcaaaagcactaatcccatggtgagggcctcaccctcatgactcaccacttcccaaggtcttaccacctgataccatcccactagggtgacgatttcagcatggaattgagggggcacacattcattctatattttagattgtgctacttgcaaataatttcactgctggaaaattctgaggggctggtcaataggaagtgcatgtcattgcaattcttatttgcagtccattttcccatgggttggaaagtggggaggaaggcatcctactggtctgggaagatccatttgctgatacaggtaagcagatagaggtggatttcccaaggtggaaatcctaaggtggatttgcttagtcttgggacctgttgctgtccacgcccctaccttgggctttgctgttcctccttccgccccacattggctgagagcccagaggtcagctatgcttcccattctgtgtggactctgccatatgcatccataaaggccactgccagccacactctgcatccctcatttatggtccctggaactgggaccctgtctgtgctaccccttgcttccttctcctgatgtttccaactggagagggagaggacattctcattccagagcaagccctgctgctccctcgttccatccatcatttcttcgcatgcaaagtaccttctaaatgccaccagaaaactttctgtcagtcagacagacatgcttttgaactgaaacatactttgattagggagcaaggtgagccgattctttctgttacgtatcagcaaatggatcttcccagaggggtagaagccttcctccccactttccaatccttgagaaaatgggccgcaattaaaaagacaagcacttcctgtttaccagcccctctgaattttccaatggtgaaattatttgcgagtatatctcactctttctcagaggttggcccagactcccaggataaaggaaagaccatttgggtcttcacatactgggaggaaacaaaactgaagacttttcaagcctctcaaacctactttacagtgattctctctttcatctttctttttttttctttgagatggagtcttgctctgtctcccaggctggagtgcaatgaatggcgcaatctcggctcactgcaacctccacctcccaggttcaagcgattctcctgcctcagcctcccaagtatctgggattacaggcactcaccaccatgcccgtctaatttttgtatttttattagagacgaggtttcaccatgttggccaggctgctcttgaactcctgatctcaggtaatccacccacctcagcctcccaaagagctgggattacaggcgtgagccacagtgcccaggccctccttcacacttttaattgggaccccccctgtgtcttgagggactctgagtggcattacagtggagtcactttgccattaatcctatcactgagagcaccaagcaggtgttcatgcccaggtaggctgagcatctgtatcaaggcttcctgagctttcctgtgccttccatcgtcacttattttactgcaaaataacaaatgctttttggggatacactaaagctaccacacatttaatattgactctggagtttcaagtaacttaaaatctactaatctcagtgaactttcgcccagagtataatgttttccattttctatttttcctttcatgtagttctactctagagatggatgtgagaaagataatacaggaaccatcctgtatctcagcaaactctactgaaatcagtaggtatcatgtatgtgcatgcacgtacacacacacacgtgcacaaattagccctgtaatgttattccatgtcagattgttgcctttggccaaactcagcgattgtgaatgacatctcctgctcggttcatgtaacgtacaggagacctgttcttagcatttaccattatccttccagtcttgactaaggttgggtgcacattcacagagactaccaactctcgattcagggtttgaaaagtctgaatggttgtgtattaaatggaaaagatcagaccaatattccctagccttggatgaaactgtttgtttgcaaaatgatgttttagacagaagtgagttttcagaacattaaaagattccagtgataatatttgcaaatcctttcatctgcatgaaaatttagcaactaaatctggccattaaagcataatctttatttgaccaaagcatgatataaaaatggaataaactataatttatctttgctgacagctaattacctggaagtctgattaaagggaaaactaaatttacttaattagtgttttggtgtttaatctgtatacatataaatatgcctatctcctctcctacatgaacatttctagaaataaattaccatttttattttgtccctttcagatgctgccaaactgagggcagcattagaagaatgggtattttagcaacaatggtagcaggtgtttgtagactgtgatcccattagaggagcagagtgaggtaacacaagaatgggatgcttaccacaaagtagttttcttttttccccaatggctcctcctttaactgtgaacaagaagagtgccaacttgtggagtgaaccagccctgccaatgaatcctggcttggtggtggaaaaatctgcatataattaagccccttgaggcaagtggactttgatagacaagaggtggctttgaaaacgttgaaatcatttgttttttagcagcagtatttggcagtgttgccttttgacggtttgaggaactatgctgtaagtacagccaaaggcagaggaggttttatggaactctcagctcccacccccacctcctgatgctgcaaagttctcccactagatgcaatttaaacaggagacatatgtaacacacctcaggtggtgtaatgaaatcatcctcttttctgagcttctgaaagtcaaatatacttatattaattttttaaagtgatctgaaagtcatacgattctattcttgaaatagagaggttttcgttacttaagtggcagacttactgacagttcagttataggcttacaaataattggactaaaatatgatttttataaagcattgtaggttttaatcaaaatccctacagaaatgaaagtcttaattaaatctgaaatcctacttcccagacctgaagtttccaatatcattttttattctcgcccaacatcctctgtgattaaaatagaacataagtggtgaaatcgctgattatttaaaggatagcatcatagaaacaaacccaaagcacgtagaagtcattttagactcatgaaaggtagaagatgaaagaggcttgcacagcatcttcatctcaggaagacttttgggtcaggttctgttcatttcattatcgtcactcttctcggttgcataattggaagttctctaaaataactacttctgacaaaatttctaaaagttgctgagtggaggcttaaaaaaggactaatatccttaatgatttgataaagattaaaatcacagtttcaggaagggttactttttgcctacttcacagacattcaccctcttctctggtagcctggacagtcattttctagaaccatcttccttctttattctgccatttggctgaatgacccttaaggtgacacaaagtaaagggactatgacaaggttaacaaatgtgcaacacaagttgcctgttctctgttgtttcgatgaagcattcagctcaatataaaaaactatatctcattaatacaccttccaactgggcagaggatgggagcacagaggggtccacagctgtaagtggaggcaaacatatgccatgaaacccaggccagtgaggaagggggtgacatgtggattttaatagttaatttttgttgttgttgttgtttgttgttgttgttttgttttgttttttgagacggagtctcgctctgtcacccaggctggagtgcagtggtgtgatcttggctcactgcaacctccacttcccaggttcaagtgatgcttctgcctcagcctcccaagtagctgggattacaggcgcacgccaccacacctggctaatttttgtatctttagtagagatggggtttcaccatgtcggccaggcttgtctcgaactcctgacctcaggtgatccacctgccttggcctcccaaaatgctgggattacaggcatgagccaacacactcggccaatttcttttttgatgtccaggtacagagaagttgacattttcatttaaacacatacttgacccaaggacacaattcctttaatacggctgggtatgctaagctatggatcatcagtgccacagtaaaaatggacttgtgtttataggttgtctcctggagattgttgtgaattatatgcattttaggaaataataaacttgtaatatgttcgcctgtgtgacttaacgccgtgtcagctagagtaagtgtgcagcacatccaaaccggaccttctatggctttaatacttctgaagacctctgtaaagattcttccttctcagtacccaagtgctgaaaaaaaacatgtattattataggtcagaattagcattttagtcagttattctagaagtagagtaaaaaacaaattttcagactcacttatgtatttttcacatgggtaatcctttgagtcaggaaactggctagagttacattccataaataaaatgttttgatgatgatgccaacttgggcatggccttgtctcttaacttaggaggaggacaggcagacctggggggtgatgattaagtaaaatatcagtcagacagatgaaccgtaggacaaaaccaccaccaagggctgtggggatggagatgagaccctggtcacctcccctggagaatgtggagaagacttcaccctatggttgatggacatgtggtctggggctggaaggttcagtgggattttaggaaggggagaaggaagcaggaacaggggaaacagtttgatctgagacactggtgtaaggttgggataattttcagtgacatggggaggaacacggccttgaagggtgggagagtggtcttccattcatgacttactgagcctgtcatatgtgtgatgcagtggaatccacagaggattctgtcctggatcacacgcaaacccagccttcatggagcttgtgtgtggtatggcgtgctaagtcgtagacccattacttaaaatgactgtgttgttaaatgtcaaccgagtatcatggagacattcatgatgggggactactgtggtctagatcagcggtgtccactaaagacatttgaagacgggctgggggcctgtggtctgacccaggccaggaagatgtgtagttcagagtgagttgggtatcactgctctgccttgaacaggtgcaccctggtgttatgggactatcaggttcaactgcccgttgcatggtaacagaccaccagtacaccaaaacagcaggatgtggagcagacaatgtgtttaataatcatagggcagctgaacaaggagacaggaggaaacctcaaatccgcctctctgaggagctttacatgggtgtttttaagggaattttggttagggggcttaggagctggagatcactgactggacagtgtgtgggaaatgaaatcataaggatgtagaaattgcactcctgcgctgaggctgttcctcggagggcattttcagatgggctggagtcagtgggcccattggactgtaggttctggaaaatatctccaaatggaaaatttgaggtttcttaacatttaaggtgttacctagagaagttaggagcatgtgacgggggcacgtgacttctaagcagcaagcagctatcagaaagtgggccaaaggacaagctggttaatgcgtcactgtgcttctacttaaagcttatgcttttgttaaaaatttagcaatttggttttattaattttatgaggacggtttccctggtgagcatttggctccacagagagggatccaacagctaagagtctgcagtagaggcgggatcccacagcttcactgatcaccccattttcctgtggccccaccaccatctcttctcttctcccaggaccctagctcgggtggaaacagtggggaggccttggtctccagctcagaacccaggagccaaaaatagcagctgagtgtaaattttcattaagacaggggattagagatcaaaaggggtggcctcccactctccagaccccaactcctccctgagtcagcacccccacctgcacctgcacctggagggaccctgcctgcccacactcggtggtggccacagcctgcatctagcagggtgtaccctgtgccaggtggcaggagagcctggaatgtgctgtcagttctcagctgatctacaagggtaaccacagtcaaagccattttaaggaggggaaagttaagtaaggaagaggccaattaatgtgcccatgaggatgttaacaagcagccttggaattggagccaagacaggactccagagcctgcatggggggcctctgggtgtatcatctttgctccagctgagcaccggcttgtctcaagaacaggctactgcatggcacctctgctcccctggggtcctggaaaggttccctggtctggggcatctgctcccagccctctggaaggtgggagtgaggatgatgacatcccagcagggcactggccgaccagcctgctcctatagcaatgccttcctgtcctcctgcccactgcccctttgggcactgctggtggccagcactggcggccagtgctggcctcttctccctgctgcagagctgcttccataggcggacctggtcagagctcaagtggaggggaagcaaaccttttggagtgtcttgggttacctccttaaacattaaagacaaggccgggcacggtggctcacgcctgtaatcccagcactttgggaggccgaggtgggcagatcatgaggtcaggagatcgagaccatcctggctaacacagtgagacatcatctctactaaaaatacaaaaaattagccaggagtggtggtgggcgcctgtggtcccagctactcaggaggctgaggcaggagaatggccagaacccgggaggcggagcttgcagtgagccgagatcatgccactgcactccagcctgggcaacagagtgagactctgtctcaaaaaaaataaaaattaaaataaaaattaaagacaaattaaaaatttgtccttaaaaatgcagggacatggatgaagctggaagccatcattctcagcaaactaaaacaggaacagaaaaccaaagactacatgttctcactcataagtgaaagttgaacagtgagaacacatggacacagggaggggaacatcatacactggggcctattggggggtgtggggtaaggggagggagaacattaggacaagtacctcatgcatgtggggcttaaaacctagatgatgggttgacaggtgcagcaaaccaccgtggcatgtgtatacctatgtaacaaacctgcacgttcttcacatggatcccagaacttcagtaaatttttttttagatgcagatgtttatgcactgacttaaatatttaataaggcatgctttaatttgtttgtttttacttattgttttaaaagctagagtcctgaccaatttgcttctgcctccacacattttgtttttagagatataaactacaagtatatctcagcaatatgaggccaggaaagagatgctccgagcatgctctgtagccgtggcccctgggccagcagcatcagtgctacctgtaggcttcagacctgcagaatcctagggcccagcccagatgcactgaatcagacctgtattttaacaggtcccctgggtgacctgtaaccacattccactttgtgaagttctgtttaaagaagcaggcctgggatttgcttactattcagtgaaactttcaataaagcttcttttctcttcctccgtgaacggcagttattttctcgtagcaagagtctggactacagttgttctgaatcttttgagtagatattgaaggggagatacatgagcatgcaagcagacgtgcccagtatagcgagaaccagaataatgaacccctgcaaagtgggagggcatttggaaagagtgcacgctgagttcatccccagcataaaggaaccagcccgttattctaatctgatgagggaattcttcctgacaattgagtgatggaaggaggcattttaaatctttccatgtgtgtctcttctggcaagtggacagggcttgtgatgaatcctaggtctgataccagggtctttaatgtaaaagacaaaaacatactagacatctagcctattaaacttgaactccagccaaataagagctgatttcctgctgcaaatcaacaaaagacctcctgcacatggaagacgactctgacactaacactgatttagggccaggaagcctgcagtttaaattaagctggaggatactagctttatatgaaaatggcaggcaagtgtctgtggctcacagaacaagtatgatatacttttgttgcaagacctttgcatagaaaatcatcttcttttagaaaataaattccgttgccaagttttgtttcccattctactctgccccttaatgtccaaggagaattctccctgaagtccttgaggatggggcttattcagcacatcatagatttatgaagcctttgccatgtgtcaagcactgtgctaagcccaggggattaagagcaacaggcaagccacagtctccctctgtgcaccagccctggctccgtgaaatcaggaaagcaggaggaaagaactcaaagtgcacgcctggggaagtatcactgccacctaaacccttcttctcagctatcttccctatccaaccactagacacactggtgtttctagtcgtctcaacttgctctctttctatgagttccacaattctcagtctagtaataatagccaacatttcttgaatattgtcatgtgtcatgtgataagcccagtgtggtgttttatatgcattttaccatttaatacaatggccgtataggaggcactatctttaccctattttattgatgagatattagggactgggacagacactcctcatcctgagcctaagccactgcaacagcttgtaaactttcccttccaattccaagctactcctttccagtatatcctgcaaatggcttccctattaatattcctaaattatgatttcgctgggtgtcttttctcttcccaaagataaacactattttgacaccttcaccatccattcggtttggcttgctttggaaccctgtataaatagaatcatgcaatacatattcgtttgcatctagcttaatttgcctaagattatgtctgaaagtcgcctcacatgtagtactggttcactcttcgcatttctgtaaagtgttttgttttaggaatgtagcaccatttattccttctgctgttggtggatgttcatattgcttccagacttgatcattatgcacaatgctgcgggcactcttgtatgttcagtgcataagtgcatgcgtttatattgatggttgtgagctatgaacatgttcagctttggttgattctgccagagatttccagagtagttgcaccaatttatactcccatcagcagtgaaccagaatgtcattttctttacattctctcctcacctgcccttgggaggggtgaggctgttttggtggtggtggtgtttttaccattctggtaggatcccattgtcattttgatttccatttcttaggtgacttgagcacctttttagatgctattggccatttgggtagcctccttagtcaagtacctattcaagttttttgctcatttttaaattgtattttatttgctcattttgtattatgttgttattgtatggctcccttatacttgaactacaaaagttatttatatattctaggtatgagaccttcatcagatacattattgcaaatatcctttctctgtagttggccttttcatataatatttttcacaatggtgtcttttgatgaacagaattttacaattttgatgaagtctaatttgttaatctttgcttttttagagttttaatgaaatatctagtgttattcaagatcatgaaaatgtttctgttatttgctagaagctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccccaacccccccaccaaaaaaaaaattctaacttattatatcaatcttttcaatagtcagacaattctatctaagaagttaaatgtaactgaattccatgggcttctcaatcatttcaaaaattacaacttttaaaacaaaataataattccggaagtagatatacacattttcctgcaaatgtttctgtactatgtcacatcttgctgaaggtcattttagttaaattaatgtaaaatgcagactgcatgaaataaagaataaaaagaacaaaagaatagcaaatagaaagaattaaaaaaacatgggaaggcaattagcgaattttgttgaaatttgacactacttaattagcagctcaaatttcctgaagcttgaggctttaccatctagacaatattacattgaattttgggggtttaaaaatataattaaaagtttattggacaaaagttttacccacacctagcacatcatagacaacactattgataaaatgaaattaagctactgtatttgattatcctcataatatattttaaatgaaccatgaacaatgaatagctgacctatagtaaaagcaagaggttaaagtaaaaagaaatgtatctaaaatgaaaaaacatacacagtagttttctttgattttaaaccaaacatggatatgcctgtttcattaatgcattatctttagaaagtaatgtggggcttttttttttttttttgcaattgaaaataagattcatttaatcagctatcgtagttcatctgttaaattacagcactttgctgtccattttgtaaaataatcttcaaactaatgaagtaaggtcaattgcatgcaattttattctagccaaattgctgttaattgcatcaacggctttggtaaggtcaataaatgttgcctttttacatcctctcctgaaaatggcagaaaataaacaccttttctctgtaatgtattcaggctcgaggcaactcatagcaggtggactattcgattttcattacctgatttgaaaatgttccatttctaaagaattgtgggaggtattggagtcaccaaagcacttttagcaaagatatcttttagctgggcctggtggctcatgcctgtaatccaacactttgggaggctgaggtgggtggatcacctgaggtcaggagtttgagaccagcctggccaacatggtgaaaccccatatctactaaaaatacaaaaattagctgggcccgatggcacatgcctgtaatcccaactactcgggaggctgaggcaggagaatcacctgaacccgggaggcagaggttgcagtgagctgagattgcaccattgtactccagcctgggtgacaagacaatgtgaaacttcgtctcaaaaaaaaaaaaaagaaaagaaaagaaatctttctcggaagtgctcccttgttactcttgaattatgtcagtggtgtccctcaaatagagacaaacttatactgaacaactcagagtagattgtggaccttgacttgttaagattttaatttttatgataatcagtctagagcagatcatctgttctcctttaacctgtcttacaacaaacagtaaatgtttgtatgtcagctcaaccatagttatactgtgaggtataccagttggctcacctgctcagccgtgcagcctaggtcagtgtaaggaggggatatattacctggacccatggagggttaggacctcgctgtggccttattcctgctgcagacctgacccagtctttaggacttgatcacatctttacaagctttatgctttaagatatgcttttctaaccatctcaatttgtaaactgtgaacactctgtggtttctgaaatggcggagatgtgtctgaaaggtgtcatgtgcgccgtattacaaagaaaccctaaaaacagcaacaagtgagagatacaggtggaagtaagagcagtggctggaggcagagagagactgtggcaagcggatggcactcgacgtgtgggggcagttccctaggacctctgggagagttgcacttatcctattttccttgccttcacataaggtcacaatcactattagagtctgtttgatatactcattactaatattgattttacagttcaagaaacaatatttcttcttttgttttgagatgaagtctagctctgtcacccaggctggaatgcaatgacgtgatctcagctcactgcaacctctgcctcccaggttcaagcaattctcctgcctcagcctcccaagtggctgggattacaggcagccaccaccatgcccggctaatttttgggtttttagtagagatgaggtttccctatgctgaccaggctggtctcgaactcctgacctcaggtgatccacctgcctcggcctcccaaagtgctgggattacaggcgtgagacactgcgcctggccaagaaacaatattcttcttttaaaactgaatgagcagaaatactgttagtagccagctgaattcaggaaatgtgatgcatgtgctggtgcacatacccaagaagactgaagacagcatagaaggacagaacaaaaggccagtgccaagggtggcagagggagtccttggtgcactctgggacaagccccctgcgtgctgggtgtttcgggtggtctgtctccatgtgcaatatcagtcatgtgaagccttaacaaggcattcatttagttagtatttcagatttgccaaccctgttggtgttgggataagggttagagatacagagaagcacccctgccccggaggagatcactgcctggtgagaaaaccaggatgggcttctactcaccccttcaagtccttgatgaaaggttccttctgcaggagcccccagcccctgccttctgctgtgtcctgctcctcctcacctatgctcctggcccctcttcccctgccttattctttatggcaccattgcctttccagcttagtttcagtggcttgctcattttcatttctcctcactatcacacaagctcccagagagcaggaggtcttgtcattttttgttcatttgtttccaccaagatacttagaacaatgtctggcatggtgagccctcaaaagtatttatggagggaatgaatgaactcgtgaataaatgaatgtatgaagtactaatagatgggtgagcatggaactctatgtgatcaagtgtaaaaggcactttcccaaacacaggacttaatgagaggcagtcagatagtcaaacactacagcacttgagttagagaaacgttttgactaatcaaggaagcctttctgggaagtataaatgtctgcattagaactagaaagtctagaacgccgtaggaaggtacagaggacaagaacgatctccttgggcaggcagaaatgatcgagctgcgagctgccggaggaccgcatgcaggggaaattttgcttttctgagtgctgcttggctttgagatgtaagatttagacgttagacactttctagctcattttactatgccagtagtgatcctccctttcttatttctttaagaattgaagctggcatgaatctgttttcaagctgccatttagaagttggaatagtgtgttatattaactttatttattcttaaaatatcatcttggtgcccaggatgacactgcctgaggagctatcaaagagccaatccctgtgggatttgtgagaaaattcagccatctctagacctccaattccaaacctctttcatctcccaagactctatactttgatctaacctcttgagtgacttccttcaatttcttcctttcacagcaacaatttcagtcccagggcatacacttatacttataaactatttctggggccagcttgacctcaaacccgtacaagatgatcgttccagacagagaaattctcaggacatgaaaactttcttagaatgtgctgaaatagggttgtgaatgcgtgtgttgctacctctgaaaacttgatttagtgctgtccagcaaaagtcttgacatcctatgttagttggctcagctctatacaaagaatctgaaagcacggtagaagatggttggcttgtgttaggttagaaaggcgtaacaatgagttgttttctaagtgaccagcatgtgtgatttatgactgtattccagaaaaattcaattatatgagataaataagtacagagttagtatggggcttcagaataacaggaagcagcataaatattgccctcgcccaccagaattcatcactgatggcctgctctggccctgccttctgctgtgcatggaatttttattgagcttgatgagattctgtgtaataagatgctggattccgggggctaatggcctacgagaagatttgagtgttgagattctgtataatcagatgctgaactccatgggccagtggcctattgagaagatccgtataataagatgctggattctgtgggccagtggcctatgagaagatttcagcattgagattctgtatagtaaggtgctggattctgtgggccagtgggctatgagaagatttgagcgttgagattctgtataataagatgctggattccgtaggccagtggcctatgagaagatctgagtgtgcctactggatagttacctgctggaatgcaagttgtcactgcaagattgatttctagtgacaataacaagcagaagctgactaacagcacactgcccaccatctgctcaagatacccaataaagtgtatttgttcctcattttctcggaaaagtctccacctgaaggtcacagtgagatagaccaccacagtgaaaggacatttgaggtttcttcctgcctgcactggtgatgacatcaggaaacttgtgaaaccacggtcttttgtttacattagaaaatgcatgtgagatgacaggtcaacatcagcaaggcataacttaacagagataaaggtaatgctttctgttggttagaaaaagcaaaagttttgaaaaacacctgagcaaagaaatcttgagaataattgctagccaaaaaaaaaaaaaaaaaaaaagaattggggtcatagggaccaacattgagacactgttgttgaagcagcaatgaataggtattttgtccaaataaaaggacgtaatttaatcattgttaatgtattgcccatcattggtaagccctcgggcatacacttacacttataaacttatttaatccacacatagcattatgaaggaggcattatcatccctgccttacagatggagaattggagtagaagaagtagtaggtaacttgcccaaagtcatagagggtatcgacttatcgactgcactgctgagtttagggtctgcagtttgtctgccatgatggctcacatctggagtgtcaggttcagccctagaagccacgttgtctggtggtgaacactgaccatcttgcagtcactgggtccacaagaggggaaccactgtgagaaggtgtcctgtgaccaacattgttgaggagtatctaaagggtgaattcagggaggttgtgctacagccttaaaaacacataaagtaactcagcgtcatcctttcttgttcacactggaagaactgaagtcaatagctggtcctagggagatgaataccaatatgagagatgcaggctgcacagacctggaaacagcttctgtggcttcgctcaggaaagaagccagacagccttctctcagggctcctgcaagtgggattcctgccctgcgggttcccaggtgaacacaaaagtcagttccaactctaaaattatttgtcattcggtacaacaaagataccactgcctccctagcaatagagttttttgtttgttttttgctttttgagacggagtttcaccctgttgcccagactggaatgcagtggcaccatcttggctcaccacaacgtctgcttcctgggttcaagcgattctcctgcctcagcatcctgagtagctgggattacaggtgtgctttatgatgccatgctattttttttttttttttgcatttttagtagagatggggttttgccatgttggccaggctggtcttgaactcctgacctcaagtgatccacccacctcagcctcccaaagtgctgagattataggtatgagccaccatgcctggccgcaatagagttttaaatccttctagaaggtactccctgagccaaccttgcactctctttgcaccccatggttattctgatgaggcagccattcaaggccacctgggctggaggcctggctgctccgagtgcagccctgctccactacatcagcatcaactggagcttgtttggagtggagactcttcgtccctgcaccaaccatcactgcagttttgcagggtctcagatggttcccgtgcacatgaaggttggattcccacatgaaaggctgtcatcataacccacctggaggagctttcagaagactatggtctaggtccttcctcctcccctccacccattgttcttggtgagccctaggcattgccagtgagggtttccaaagctctcccagtggctacagtggcagccagcattgagatgccctggtataaggccacagaagccagccacagtgaccagccctcctgagggttggccatgaactgatctctagggctctgttgagccttttgaacattgtttagagtaagaggaaatgtagttgttataagaaatgctcaatgttccagaagtgctatgagttactagaacaggaattttcaatggcagttttattccagtttgtccccagtgcttcaagagagggttgggtagggctttatgtgtttggggaagttgctgaagaaagcagctgaataactgaatccttttacttataaaaaggttcaaagttgtccagctgaaatgctgaggttgggagccttcaaattgaggacctcagggttctccaaacagaaggcttgcaagttccaggctgaggctaggggagctgtctgtgtctgtggcccccatgggtgattggtcccctctgtctgagcacgtgcgcggaaaaccatgctccgtgggttgacagctggtggtttgcttatttgcttgttttgaaaatgtctattttttaagactctattgtagctgaatttaatataaatgctttcatttgaacatttggccatctttctttagctaacatgtgctcttatttttatttagcctatttttaaccattgagttactacaaaacattatctcaggtttattttcatctgttacatgttttaaactgtagccatctgtgtctgaaacatttttatctgctacaagttaatattttaaaatgttattaattgggtaattatttagctgtcttcaaaaaacaaaaacaaaacagcaatcctgcttttccagctagtgagcagaaagtcagggcggtggggagtgtgttgtctgtccagccctttgcttgggacgggagtggtctcttgtgcttccgtgccctggtcttacctcaaagttactttcttaccttgaagacccaccattaaatataaactaatcagcctatataaacacaaatataaccagtaaaaacaaacaaatcaaactcatcataagtataagcttttagaaaagactgttgtcccaactttgacaaaaaagtggcatagtacatcatttgaaattcaccatactcacatggatgatgtcaccatccccgccctcagactcattgtccatctgttaggaagaggtgcacccaccacaggcagagcacagctacaggcccacacacacttatgccgcactggagaaaccgacctgccagcccagctcatctccttgtttcttgaattacccagttcatgtatgagaacaagaggaatgtgatctgaaactccccagttaacaagctgtaaaactgcttgacgcctgccaggctgtgcgaacaaaccaaggggcaggaggtgagggcaggggcggtggggtggggggttgcattctggaagagtcccagggtttcctctgcatcccttcggtgagcttagtcgcagtaccttagtcacagccaggtagctgccgttctcccattcccaaaggacaaatgtactaggatttgttaaaaagggaaaaatcctctgcatctagaaccaaatacctctctcatctcttccctgatgggagtaatcattctgcacctcgagattgacttgatgtcttaacttttgcattggatgatgttacctatgttgggagttacatcggaaccggcacagtagttgtcaacttcagctacatgggaaaattcatggaagaagcttgaaaaaatgtaggcacccagctgacattcattattgaatgaagtcataggataagcttctttctattagatttttgccccagcactcagatgacctccacaatctacagacaacccagagaagtgggagggttctatcagtgagttacaccgggcttataccaccaaataactggctcaactggactcagaaaatgggctgttcatttgacttggtgtcaggctgaaaggaagcagcttcatccaccattatgtcaagacatagacgagttcagaaattcattgcaccgtaggttattgttgagccacatggaattaaagggcttgcccaaagcagatacttctctggattttgccaagctaggcagtcacacttcccccaaaaagaaaagtagaaattagacaaaaataaactttatagcactagaaccaattttaatgaaccacaatcatgatacggatttagtagagaccataaaatccacaggacaaggtgcgatctccacttgcctttggtcaaagctgagaaacaaagaaccggaagagctcactccattgtgtcctgttttctatggagagatgagccccccttcttctcttcctgtgaaccagcttgaatcggaggggaacgtgtaactatgaggttcagatcacactggaacacagcgtggtccatttatgctcagagtccgccaggtggcatggacttcagacagcacagataccctaattaccatgcctggtcttgcggttcacattcaccgtccttcttaaaagtggggaagggggccaggcgcggtggctcatgcctgtaatcccagtactttgggaggccgaggcgggcggatcacaaggtcaggagatcgagaccatcctgactaacacgccacggtgaaaccccgtctctactaaaaataccaaaaattagccacacgtggtggcggacgcctgtagtcccagctactcgggaggctgaagcaggagaatggcgtgaacctgggaggcggagcttgcagtgagccgagatcgcgccactgcgttccagcctgggcgacagagcgagactccgtctcaaaaaaaaaaaaaaaaaaaaaagtggggaaggggaaagggagccttgtctctatcttccggggtaagcctgcgctgctgggctcctgacaggttccatagactcctcttgcagcacctggggtgctatcttgtcacagcttataacctgctccagagcctggctctgagcaaaattgctgaggctgaaaaaagacagtaatgcaactcaggctgctagggtgttctcactgacaggactgcagattctgtttggctgaccacaagttacaaagatgaagacaaagtgcgagcaattcaagggccagcttgactagctggtaaaacgagtggcaaatgtactaggatttattaaaaagcggggaaaaagattccctgcatctacaaccaaatacccctcccatctcttccctgaagagaaatgattctgtaccttgaggttgaccggatgccttaacttttgcactggatgatgttacatatgttgggagttacttcagaatcggcacagtggttctcagcttccgctgcacgggaacgttcatggaaagaaatttaaaaaatgcaggtgcctagcttgcaactgcagagattctgacttcactggtccgcggcaggattcctgctcttagatttaggtaatctgagagttccccccaagtgattgcagtgtacaaccatggtaggcaccgctgcttaggttgaatgacatcagcagaatgttttaaatcaacaggtttcatgagtttgagatggaagaattgggtgaggtagaacccattaaaatagttaaatgggataaaaaaaatcagaaagttgaaacaatgaaaggcagatgtgactttgtaatcatcaggacatttagatttgcccaagtcccaatacaattccctccctgtgaagccttagaaattcctcagaactgtctttagtaatagaggcatgcaatatgattggcagatgaatttacagggaggagtttgagcacgcatggaaaacgttctgattttgttgtctttgagatgctcttcgatgtcacagaaggaaatgtatgattagtgtcggtgttcttgtcaagagatggctctcttcctttcttaggggaggaggcaacgacgagctttccatgtcccattggagttgttgagagacagggactgacaagatcaataattgtttccaaataatggggcgcattagcagcttcccagggtcatgctaaggtgacaggtgggggcagatgtggacagagacccggaaggatcctaactaaaagggaactcattatgtgtgatggtccccttgccagccataggagacatttctactagccttggttaacctggagccacagtgtgatggcaacaggcgctaggccatgttttgagttagtgtaatttcaaagtgtacagtttaccaaatttgaacttttttttaaattttattttttctagtctggcttttgcaagtgactctgacaaaatatttctgcattcaaatatctggcatttctataacaatttgagaagcttggccttataagaaaatctccaccaacacctggtgtatgttcatgtgctttataaatattaatttcattgaattgaaaagccaaaagtctgtttttatgatataggtttgttttcttgacttttctccaaaattattactagagtctcattttttaaaaagtctgacaggaacatacccaacatatatttttaagtaatacagcagaagaggaaacaattagaaatcagagtgtgtagcatgagtaagtgtaaatataatttcctgaaatcttcatttcaattgtgtgtgtatgcaattagattgtaaaatttattattgattgattgattgattgatttttgagacggagtctcgcactgttgtccaggcgacagtgggcgcgatctcggctcactgcaacctccgcctcccgggttcaagcgattctcctgcctcagcctcctgagtagctgtgattacaggcacctgccaccacgcccaactgattttttgtatttttagtagagacagggttttaccatgttggccaggctggtctcgaactcctgaccttgtgattcacctgcctcggcttcccaaagtgctgggaaggcatgagccaccacacccagccgtgaaatttactttatactgtggaatgtaagtgaaattctgaaagctattggataatggcgttgtttagaataataaccttatagcgtaaaccacaaacatgaagtcagccgactactgcgatgtatgccaagcacaggaatctggagaagtacgagcctcctggctccccactggactttttattggggtgctagaccagtggttctcaaagtgtgctccccggggcagcagcatcagcctcacttgggaaattcctagaaatgcagattctcaggcatcctatcccaagcccaccgaatcattatctctgggggtgaggctcagcaatctatgttttaacccttttcctgtttgctttgagaatgttctctggcagcgcttgcggctgcagtgtttactccggataattttgccacgaaacatctcacttttgttactgtttttgcattgttctagcatatcgtctttggaaacaaaagacatcattctatttacagcattctggttttagtagttgtatttccatttacaaaacatagtaattctcgatcgctgaaaatgtcaaatcctagaaaacgtagcattcctacgcatgatgttaacatcgttcgcaacagttgttgaccaaagattcattagatgaattaaattttcccaaagtagatgattctgatgttagtaacaagaacagtttttatatttcactttcaaattgaaaatcagatttgcttcagcttcaaagagcatgttaatataaaattaaatgagcattgacggcaagctgcatttttttcctaaacaggaaaagggttgagcctcgcaggtggttctcttctgatatgtggcctctgagagaatacctggccagccaggtatgaaggtggaccatgacctccctgtctcagctccaggcctgcgcaatatccatcaatcccataggcatttaggcctagaagctaatcatgatgggtgtttcttttgtttgttcattcgttcgttcgtttgtttttgagatggagtctcactctgtcacccagacgggagtgcaatggcccgatctctgcccactgaaacctccaactctgggttcaagtgattctcctgcctcagcctcccaaatagctgggattaaagacacgcaccaccacgcccagctagtttttgtatttttagtagagatgaggtttcaccatactgatcaggctggcagtgttttcttctttacttctgttgctgaagtttgtaactaactttgtgtcaactgtttatttatttatttttgagacagagttttgctattgtcacccaggctggagtgaaatggcatgatcttggctcactgcaaccttccgcctcctgggttcaagcgattctccagcctcagcctcctgagtagctgggattacaggcacccaccaccacgcccggctaatttttgtattagtagaggtggggtttctccatgttggccaggctggtctcaaactcctgacctctggggatccacctgccttggcctcccaaagtgctgggattacaggcgtgagccaccacacccagcctcaactgttacttgatcaacccttaacagaatgtggaagttagtgaattgctaacgctgcccttggcctgctatttcccagctggcctctctgtgcccagcccagctctgagctgccacatgtcccctgcctttcaaagaatccaccttctggcctgacttttctagctaaattttacaaaccataattcctagctttcctattttctcagaaaaatgtccaccaggtgtttattcaggtgtctcattgttataatccaataaataaacacatcatattcatgggatagcagatatatgcatttatttatttatttatttatttatttatttatttagatagagtctcactctgtcacccaggctggagtgcaatagcacaatcttggctcactgcaacctccgcctcttgggttcaagccattctcctgcctcatcctccctagtagctgggattacaggaacccaccatcatgcccagctaatttttgtattttttgtagagacagggtttcgccatgttggccaggctggtcttgaacccctgacctcaggtgatctgcctgcctcggcctcccaaattgctaggattataggcatgagccaccacgctgggctggatatatgcatttaatagggactctttgatgcctgagggctcatgttatcaattgtgaatacaagacaggcctatgggaggggtgtttattttttgggggggaggggggatgggcagctggatgggagttgagagtggtctcatgttcatcaaatcagcccaagtagatgattgatttctctgcctcagtcagattttgtgacaaggtaaagcagtagattcttgagtagttgataaatgatattacaatcttttctaaatttaaactcttcgttgatctttgtcctgtttgtataacctttatcttttttgaaaaatgttagttcagcaactgtttagtttaattagctgattcattaaacttgggtggtggctcaccaataaaaaagcatttgaatgtttgaatgtcactcagagctcttcaatttctttgcagaaatactcaacctagattcttttaaattctctacctcagaacctgatagaatacttgcatatttttactgatgatgtttcacctatacttaatgtaataagtaaacacactacacgagaagtcattctgtaggaaagtgagtgcggatttctaattacttaggcacagctagtttcctagcctgacaggtgtggaaacacctttcacactcgaagcatgcagaggcttgcatgagctcacctgagcattctgaggagcctccctatgcagttttggaaccctctgtttgattcaaaggtctgctcctgataccagggaggttttagctttctgccaaaagaaatgctctttcatcttcaaatcaaatgttgaagtgggccgggcatggtggttcacacctgttatcccagcactttgggaggctgaggtgggcggatcgcttgaggttaggagtttaagaccagcctggccaacatggcaaaaccctgtgtctactaaaaagtacaaaaattagccaggcatggtggcaggcacctataatcccagctactcgggaggctgaggcagaagaatcacttgaacctgggaggcagaggttgcagtgagccgagattgtgccactgcactccagcctgggagacagagtgaaactctgtctcaaaaaaaaaaaaaaaaaaaaaaaaaagaaagaaagaaagaaagacagaaaaaacaaacaaaaaaatgttgcagtgaaaaaatatcacctcctcctactctcaggatggtacttctgcccattctcctgagtaggctcaagcttctgaaaggagagaaagtgggagtggttgatatttcgtgactctcactggcgaaggcccacttgcagactggccctgcatcccgctgtcctgaatgcacacgtctgtgtgccgtgggatggcctctagagcgattcctccctgaatccctgcaacagacacctctgagtccaggcacagcaggatttcaggaaccagggaggagctggccaggtgtacacccgggcagatacctgtgacccgtgatttcaggggtgacagaaaatgcctcttttccaaacaccaagcaaaggaaccaaaaccaaatctacacaaacatgacctttccctgtaactctcctgattgctttcatcctgtgctttgaaacagggaaaatgcgtagacataccgggaagccagaggggccgtcgtcctggttttatgatgcgggcaggaggaagttatcaagggccgtccctgaaaacaggctttatttggacagtgtgagggatgtaaagaggagaaaggcagaccccagagagaacaggtgccctagcagagatgagaccaccccccggggagtggggagagcctcaatcagagtcccttactggaggtttgctctggggcagccccagtggaggttgctgcctgctttcatgttgtcggatcacattctccaggcagaaatggtttggaggatcctgggatttgaaggctggtgctcgctaatcatggctatgcatgaagcgtaacacagggcggtttgagtcatcttcctcggggagttttgagaggaacctaggatgccttattaggaatgaggttattgcagagcatggattttctgaaagacaaggcaagcacatggccatctggtcagcactcaccgctccctcccctgccccaccatgagtcgcccccaacacgcagtgcctgtgctgaacacactgtgcctggccgtgcgtgggcagtcacttcctagcccagctcccagactggggtcgccctggatgacagcatcacccttgtgccttgttcatttacctattcagatatgaagtcaagatactgtgggtgtccagagatgcttttttaaaaattgcttcctggggaataaaaaggaatggccattaacacattagttgacatgctcaaaatttaatttgcaaacagaagccaaaagagacagctaaaacttttcattggaagcaattaaaataggaaagcaacgggactgaacagttgatagtttgccagtgcaggttctgctctgtgaggcacgtccaggaccccctgcatcagtgtaagtcggcatacaggggttagagtgcaccatcctgggaatgcatgacacataggtgtgcttggttacagaccagcttccccaccacccaggctgaggcctttgcagacagaaatcaaacctacctggattagcacagccctggggactgaccctggaaatggagttcgcgtctcttcccctcttggcctgtctttatcactcacagctcagttagtgcctctcggcatctccttcctgctgtcttgccctgcaccatccgcttcctctctcgttttctttcttcctcacattctttcatttaaaaaaaattccaagtatgagcaaaaaataattttaatgggatgaatacactcaattatggtcttagttgtgtgcttaaagggagtaaacttagaatgtgaagagccagaactagaaggttcacagtctgtgtagtctcttcctaattaattcatttttctgtaagggccagccttcaagaaaatgtagaaataacgatttaattctattttattctttttttatttgattaataattactcaattagatccccatgactttatgtaaggagaggccatggtgtttgcttcgtgaggcggttgtgaggagccatctctgtgaacgggctcctggccgctgaggtgcatttcacaggtgctcatgctagctccctcctcagtgtgggcttggccttgcaaatgggcacaatttgcactaaatgcagactcctatggattttgcaggtagattctagtttttctgaacaatttttgcatttatttctgcatgcgctcatttaaaaattgtgttgttgtagtagagcatgcatactaacattgaccatcttagccatttttcagtgcccagttcagtggcatgagggcatttacactgctgtgcaggcattttccaccatccatctccagggcttttccttatcccgaacggaaactgcgctaattcaacacgcgctccccattccctcctcccgcagcccctggcacccaccattcaactttctgtctgtgagtttgatgagtctaggaagctcatctcactggaatctgatggtatttgtcctttgtgcctggattattccgtgtagcataacatcctccaggttcatccataggttcatccttgttgtagcctgtgtcagaatttcctacccttttaaggtggtgagtgctaagttttaaactgattgccttataagccaaaatgttagaaaccagcctattttcacacaggaggctgtgcttccagaaatctgcctaaccctgtcacgttgctgtgtcacgccatcaggctcttaatgagagcacatgaagaaaccacagattttggagttagacagactccagttggaatcctagctccacaaccacctgctgggtgaccttggggacattatttcatgtttacgagattaggacaggaatagtaaatacctcatagtgttttgtggatcaaatgagctaaggtttaaaaagtgcttagctagcaagggggagaggtcagcttcctaagtgtctgccctcccctggagtgtggtatcatcactgtcactgttgcacgtgagccattttaaggaaaaggtgtgtttttcaggttatctttcctatgccaagagccataggagtgcattgacacgtgcagaccccgcaggaactgtgcattccccgatggcaaccgtgttcactcatgcttctgtctttcccctccacactttgagagaatgggctgacattataggttttttttttcttttctgtttattttttctttttctgttttttttctttttttctttttttttgagacgcagttttcctcttgttgcccaggctggagtgcaatggcaccatctcagctcactgcaacttccgactcctgggttcaagcgattctcctgcctcagcctcccaagtagctgggactacaggcgcctgccaccaggcccagctaatttttgtatttttagtagagatggggtttcaccatgttggccaggctggtctcgaactcctgaactcaggtgatctgcccgcctcagcctcccaaagtgctgggattacaggcgtgagccaccgcgcccggccgacattatagttttaattaattctttcaacaaatatctctaagtactcattatgtgacagacactttgaaggcgctgtattgaagcataggaacttggtcctgagcaaatgagggacttaatgagagcacatgggcttgcaaaccgtgaacccatctcagggactggaaggctctgacaaaagaggagcgtgagtcccggggaagagagggcagacagttctggatgtggagggtcaagaaacgcttttttgaggaggtgacatttgagcggaggctggcgtgaaatgggggagtggattatgaagagtgccaggggaaatattccaagcagagggaagagcaaattctagaacccttgagtggctatatgcctggcacaccccaagggcaggaggtcgaccacaatggcgaggggatgttggcccgggtggaggggtaggaaatggagtgaggcaggacccggaaaggcaccatggctgcagatttctatcagctgacctttattcactacggttttagtatgagccttgttacagatgaaatgttgtggaggtcctaacctccactgtgctagtatttggaagtgaattatttgggaggtgattagggtgagatgaggtcatgaaggcgtggccccatgatgggatcagtatccttataagaagaggaagagacgccagtgctttttctctgtctccatccaatgtacagactcagtgagaagggagccatccacaagccaggaagtgagctctctgcaggaacagaagctgccggcaccctgacttggacttccagcctcagaactgtgaaatgtctgttgtttaaactactcagccattggtatttcattatggcagctggagcagaccaacgcaagccttttattctccaaatgattctggtgacctctcaagacctttctctatgacgcccgccaactttgtaaataaatcctaccctttcatgaatggacgcagagtgaggaagagtcacttccttcacactcaggagcacatatactcacctgctggcccacctcgaggggcccagctaggtcagtgccaggagaggcaaggttggtgcatttcacattacccccactgaccccaccactggtagctgcctgggccccaccagccttcccggaaaccgtgtgcatttgcacttagccagacagcacacggtgagaggcttatttgctcatatggtactttcaagaatctgcagcattgggtaatttgctggccatgtggagattcccatgtgcggggaagggctgctgggctgaggacctgagcagatggtggtcattaatagcaccaacatgtgaccagctgtaattgtgctggaaggactgaagccactgatggttgctccgtactttggttctacttaaaaaatacttttagcaggacataattcattatacaaggcagcattagcaaagaaatatcagactcccagtaagtgccattttcctacccctgtgttttaacaagtattcctggtgtttagaaatacatagtctctcagtcatcgtgtgggtaaaagtgagaagagttgtttttctcagtggatcaagactaagtcttatgagatttgaaatctagaagctctgctaaaattgcatatagcaatgcctgtgaatatgtgaaccgaatgagaaacacatttgtgtcctagagcagaaacttagattcagctctttatacacacaatgacccctcctggttaattgacttgcaatggtagtttcaggtatccagcagtagttctggctacagcagatctgtctacccactgcctctaaagctaatctctccagttaatagcttgcagcctgggcctcattaagtcaaagaacttctgcccatacaataggctgtaatcctctgtattagtatgaggtaatttggctcctaactggggaatttttctcgtctaataagaggagaaattgtttggtacagtagaaatcatatagtttcccagcatttggctcttggagaaagtcagggattctgtatcctgttccttacctctggagggattcttaagttgttttgggtatcttacagcaaacacttttagtgacaaacaagtcaaattaataataataataaaaaacctaacagttgttgactactgcgtgcttaagaagagttctgagccattttcttgcatgaactcataatgcccacaacaactctctaaggcaggtattcttatccacatgttgcatacgaagaaactgaggcccagagtgattaagcttcatttaaaaagcgtgaaatggggcagtgagtcatgaacagtgccggaggaaatgttccaagaagagggaagagcaaattctagaatccttgagtggcaataagcctggcacatcccaagggcaggaagtggaccacaatggtgagaggatgttggcccacacagagcggtaggaaatggagtgaggcaggaccagtatcgtaccagtgctaagataaaagcccaagcagtctaatttggagtccagactcttgatcattgatatgatttggctctgtgtctccacccaaatctcatgttgaattgtaatccctagtgttccaggaaggaccaggttggaggtgattggatcatgagggcagtttccttcttgctgttctcctgatagtgaatgagttctcataagatctgatggttttaaagtgtgctgtttcccccttcgctctctctcaccctcctgcttcactgtggtaagacgtgccttgcttccccttcaccttccaccatgattgtaagtttcctgaggcctccccagccgtgtgaaacgtgagttaataaaatctcttctctttttaaataaattacccagcctcagttagctcttcatagcagtatgaaaatgggctgatacaatcactattcaatatagcttctaaaacatacatttgtattatagcatgctagaccaggctgtgtgagccacttgggcactgcatggatttgggtgagccggggaagatgtcaaccccactgtcagttgttatgcaaaggggagccttgtcttcatcctaagttgaaatcttagggactgtctcttctggacataatagaagtgtgtcctgtgtccataattgtaaataaacttactggcatatagaaacagtgcctggtgagctctttttgaggatagatgctaggtcttctctttcattctcaggacccagcacaatggtggggccactcaaatgtttttgaatgaatacatgccatttttttggaagctgtgagagtttatacatcatttttcacctattgccagacatttgctgtctccatatcttactctatacatgaaagcagaaagtagaataagccattgtatgatttcagagggagaagtgaggaaatgggaggtagctgtgtaaaattagatataaactaccatcaaaaagtaattgatttaaggccctcttaaaaacacattgtcttagctttggctgctatgacaaatgaccatagactggatagcttaaacatcaaaaagttgagaaaatttatttcatacaattctggtggatgggaagttcaagatcaaggtgcccacagacctggcactggagaggagggctcccttcctggtttgcagatggctgccttcttgttgtagccttacatgtcagaaagagagagagaagagaaaactctcctgtctcataaggacactaatctcattcatgaagcctctaccctcatgacccaattaccttttgtattagtctgttttcacactgtcataaagaactacctgagactggataatttttgaagaaaagaggtttagttgactcacagttccgcatggctggggaagcctcaggaaacttacaatcaaggcagaaggcaaaggagaaccaggcaacttcttcgcaaggaggcaggaaagagagcgagtgaggggaaactgccacacaattgtaaaccatcagatcttgtgaaaactcactcactatcacaagaacagcatgggggaaaccacttccatgatccaatcacctcccaccaagtccctccctcaacgtgtggggattacagttccagatgatatttgggtgggaacacagagccaaaacgattcacctctcaaaggctccacctcctactaacatcacattgggtgttatgatttaaacatatgaattttgttgggggacacaacattcagtccataacacatgtgttgataattacaactcggttccaagaggtgcctccataaaaggtcacagagaccccaagaacagagctgcctagagttctattgcagaactccagggttgcagcaattaattttacatctaaaatgttgctgtaagaatttaccccacaaaaattgatcaatgggatcacttggacacagggcagggaacatcacacaccagggcctgtcaggtggtggggggctgggggagggatagcattaggagaaatacctaatttaaatgatgagttgatgggtgcagcaaaccaacatggcacatgtatacatatgtatcaaacctgcacattgtgcacatgtaccctagaacttaaaagtataataattttttaaaaaaagaatttaccccacaaaaatgtgggagatgtaaagagaatagaaagcttgtctttacagaagaatgctccctaataaatatagaaagcattgtggatatagaaaagcatgattatgcaattcccaatatcataattgattaaaccaaaaattagtgaatgctaaaaattattgtcatagattattggggataagatatccatagaatattcatgtgtaatttcacagattcttattagtttaacatgaaaatattacctgtctaatggagaggtctagtggacacaacttaagccaatagccaaactaagcattgccaatattgggtcaaaatatgcgcttcctgatatgaagccatctgccacccaaaatgccacttatgtacaattactgcccaaaatgtttaagtgaatctaatcatgaggaaacaagcagagaaatccagatgtgggcccttctacaagataactggcctgattcttaacatcaaaacaaaattaaaaaacaatgtcatataagcaaaaagaaaccaaccaaaaagtaatgaggttgaggggagaatatactaaattgaaaaaacacacacaacattaaccttaattgtttcattgattaaaaaaatagatgcaaaagacattttgaaaaaattggggaatttgaattggggctgaacacctgtgttgaatgtattaggtgtggtaaaagaggggtaagagtagggttgtgttagaataaaagaaggtccacattgggaaacacacgctgaagtattttggggtggtgtttgcaaattattttcaaatggcttagcaaaaagagtgtgtgtgtacacacaaatgtgtacatatatgtgcatatagagggagagagtggaggcataattgtagtaaaatgctaacattggcgacatctacatgaagtgcagacaggtgttcattgtgttctccattcagcttctcctggaatttgcaattctttagcataggtagcatggggcaggtgggaggagatcatacctgtgcacaccaggtgaatcccagttgggaaacggcaggtgagtcctggggacatatgtgtctctgctagagcatccttctctttgctccagtgctatggggtgcagacgggggacatccattcatgcttttccttcttcacacattcccctggtacctttttgctggcagggaacacagtccagtgtctgggctgcagatccctcatggtcagaagaggggtttggtgagaagtgggagactggttgctagtcctgtgagtgcatgccagaggccatctccttggttcatccctgtttccccagttctgggcacaacttgcctgtgtttgccaggaatgcatagcttatctgagcttcctcatggggtgagtgggtgaggagagatggtgttatcatcaactgtcaaagctggaggcttccagaaatgacactgctgtccagggtggatggcagatgccatctggactgtctcatctcagtgtgcaggcctctagggacatcctgccctgggcgtggggcttctctgccatgagggggatcctggtgctgtgagtgtatcacaggtgatgtggcaaaggtgggcgtgggcaccagatacagacatttccagtgggatctcgttgtactttcatacatgtcactgccggactctgtggtcttaaaagccatgaagccagcccaaggacccttgccgctccatgccaggcagcctcctggccccgtctgactcgccttagggggtgccttttactccgttgtgtacaaagcattttgaaggaagagaaggaactaacagttagtgttgtcagtattctcagaattttggcaatatcccataataagaaatctgtttgatcaactcatatacacctacacatgtaatgcctctatatgggtctgtgtgtacatatcggtatgtatagctgtgtgagaggatctatagacatatgtgtgtatgtgtgtatacacatctataatgtatgacaaaagtttcatcagaccatccgtacgctcacactttgatgtttactaacatcaaagcattagtaaatcagtatttcttaatgcgctgcttgttactggtttaggctacttatgatccgaaaaatgctggtttcagcaacacggaaaacataaaaagataattatagaacagggttaggaaaccaattctgtctgatgtgtgtgtattattacatgagagtatttgtatgtatccatgtatgtgtctgcatgtgtgtgtatttccatttatctttgcaatggtgcagggcaactgtgggtctgctgccattgtgacttgtttctgtcctctcctgggccgggcccttcaaaaactgtggagggacatttgtcattggtgtccgagcttctgtgctatttctccagaggggtcatgggatgacacagagaggccctgtgctgcaggtaaatctggaggacagcttgcgcccagggaaattacatgcaaaccaggttttcctgtcctcttgagtggggcttttttctttcagaaacccccctttttttttcctttttttttttttttcaatgatctctgcagaagcagcagcatggggctcaaatttgaagtgagccgcagatgcaggtttgcttgcgagtgactccctctgctcaaaatcgtccgcattttttttcttcttctgagacagggtctcactctgtcacccaggctggagtgcagtgctgcaatcttggctcactgcagcctccacctcccaggttcaagcaattctgcttcagcctcccaagtagctgggaccacaagcttgcgccaccacagggcatcctgtatttcaagcttcccccttttgaaatgaggattgctgacggatggtgtgcaaactttagaacttgttgtcaagatgtcagttgaatcttaattaaccattgaggcagcctgggagatacgcctattctggtaggaatttttattctttcaagttcaaggatttgtccttcatcattttccaatccatgggatggtaacaataaaaatagctaatagctaacaaatgtttactctgtgctgcgctcagcgctcagcgctcttcatgtgttttttctcctttatttgttagggaatgaatgagctcactagttgccttcttctgccataatttttcttccttgttcacatgtggttggtggtatatattttagtattcctttttgtttgtttgtttttgagacagagttttgctgttgttacccaagctgtagtgcaatggtgcggtctcagctcacctctgcctcctgggttcaagcgattctcctgcctcagcctcccaagtagctgggtttacaggcacgcaccaccacgcccagctaattttttgtatttttagtagaaatggggtttcaccatgttaaccaggctggtcttgaactcctgacctcaggtagtccgcccgccttggcctcccaaaatgctgggattacaggcttgagccactgtgcctggccaatattccttttaaaatctcaaacctgccaaaacatacaggagggagaattattagctcatcagattcagtatatcaaaatgaacctgctgacaaggtggaacataattcacagactacagctgttattaatgtgtgactatttctggcaaggcccagggtgcacaatcagaaaactattaatatataacaggctgaagtggaaatgtgaatgagccaatacttggaattcctatagtatttacactaactgttcctctgcccttctgaactgagtacttcgcaactcataaaatacaatttcctgttttccactttgcagcctcttcacatctcctatttcttctggctcctctaattaatggaaacacttgcatttgagttcgcatcgatttgcaaaacattgtttaatatgagaatattttcaccgtcgagggcatgttgattattcctaggtgtaaaacattctagtcaaatttaatataagaaagtaacatgcattgtcaataattacatgaaaaaatatggtggaagatttttttctctgattaatgactcaacagttttaaacatgtgttagtgggctgggcacagtggctcacgcctgtaatcccagcattttgggaggctgaggtgggcagatcacctgaggtcaggagttcgagaccagcctggccaacatggtgaaacccagtctctacaaaaaatacaaaaattagccaggcatggtggtgcgtgcctgtaatcccagctacttgggaggctgaggcatgagaatcgcttgagcccaggaggcagaggttgcagtgagccaagattgtgccactgcactccagcctgggtgacagagtgagactctgtctccaaaaaaaaaaaaaaaaaagtgttaatgaattctttaaaataatacccatctcttcgattcatgaaaggattctttaaactcctctgcaagagcctgagtctgcccagcatcacggtgatggcctccatggtccctcttgctcagggagcagctgctttgcacctgggactctgcacgctcaccccattcagtctcccgggtgctccctggcaggtgcaccatcatcctcatttgatggtcgagactggagcgctaagagcgttggtgcacactggtgggacccaagctcaggtgtctgtgagacaaggactctgccctccagtaatgaggaaggtggcatcccctgtccctcaggaagattattgtttatttgaggaagtgcggtgtaaagacctgaatcaggaaaggacaagtcaaggcattgtggcatccaatggcatcttaaatgcctctgggagaaggaggtcactgggattgagaacattcagaaaagatttgtgggaggaggctgaacttgggcagacacttgaatgaaaaggatgtggggagtggaaggagcaggcattccctgcagtggggtgctgagattcagagaaagaagaggtgcagggtggtgtcttgatgaggcactaagaccagctcacaggccgatgagggtgagatctcgaaatctgtctgttgtcacactgcctctctatactaacagttttttagtgaaaaacacagtgagaaccagataagtgagttcactgaattttatttccaaaaaaatggaaagctctagtaacgttctgcagtaacactttggctcatgtctaagttctttttttctttctttctttctttcttttatttttttttgagacagagtctcgctctgtcgcccaggtgacatttctcacaatagcaaaagtttgaaatatgagtgttcatcagtagtggaatgattaaattagggtacatatagacagtgggatactctgaaactgttacagatgatgatatagctctaaaggaaattgtctatactatattcttcagtgaacaaggtaaattagaaagtattatatagttttttaaattttatttatttatttattttgagagggagtctcgctctgtcgcccaggagtgcagtggtgcgatctcggctcacggcaagctctgcctcccaggttcacgccattctcctgcctcagcctcccggtagctgggactacaggtgcccgccaccatgcctggctaattttttatatttttagtagagacagggtttcaccgtgttagccaggatggtcttgatctcctgacctcatgatccgcccgcctcggcctcccaattttttttctttcttgcattatgcatttttcatcaaatgcttggcttcgtgccttctaccatgaagaccccacttcacagcgacacatgctcttgggtcactccgccacccgtggggttgtgaatcaagttcttcagggagagaagacaagctgacaggggtgggacttgagttctgtgcatctgtgatcagattccgcctccacagtgctgggtggtgggaggaagcccattcatctctgtgagactaaagtccctcatctgtcaatcaagatgctaaattttatttatttatttatttagagactggcccttgttgtgttatccagagtggtgtgatcatatgagatgctaaatattccctcgtgggttgtcatgaggttcagctgcaaccctggctggcacaggccatgacacttccagcaatgtacctgcccagctgggattaatcactgacatttaactcccagttgatggcacctgtgtacggatgaattcctcaaaacagtatcagaatcttacgtactcactggtctcagcgagtattcacagagaaagcaagaaggatggtatttgattactcaataagtgagtcctgaggggtcattgctaggcaggctgaggggtggtctctgcagcccctcacagcctttgaacagccagaactttgattgatgaacaggtgctttcctgtaaaaagcaagaagcactatggaatcacagtttttgttgattttttcccctgctggtagtctggtcttcatgatatcattcttccagaaagccaaccctttcttgcaaaagtacaaggtgtgctcaggaaaaatgctgctagtgccaagattcctctttccatttctgtggccctcaggtgtggacatcgctgccttattttccctaaagtgacaaacaggatcacatcacatatttaaactctgaaatcggtattatgaggtttaatctgtatccatgtaggttttatcttgttgcaactgtttccatcctctcgcatttccagtgcccccatattgaccaggagcaccatctaggcatccgtttgtgttcctcctgccccccacccccaccatgcttctgtctgtcttctccatgagtaggaggaggtcacttggatcgagaacattcagaaaagatttgcaggaggagactgaacttggagagatgcttgaagggaaaggatttggggggtgtgcaagagggggcattccttgcagtggggtgctgagatacagagaaggaagaggcttagggtggtgtcttgatgagacactaagactggctcacaggttgatgagaacgagatctagaaatcggactactgccatgtcagctcacttcatgaatatcatgaagaccagtccaccaggaggatccaacaggaaggcaacttttttaagcaaagggattctagctctccactggattaccctgtttcatatgtaaaagttaggttaactcggaacaggagatgcaaaaaccccatctacttagagaaagctgaggagaacaaaagtagcgttagctggagacatatgccatttgttggagtgtccactgagctcgtgcaatactggttgaagccacttctcacagagatgaagcaccccgtgggtgagcctggaaataaaagtgcatggagccaggctgtggatgacggaaatagtaaatggcaaagcagaggagggcttgagcatgggtgggcaggtgagcaagcgtgcagggtgcagaaaccacagctgtgagaaggggcttttccagagtgaggttacagaaagatcaagtgaggcaggacagcatgtggacctggaagagaacataggcaaggggcgaaagagtgtggaaagaagagaaaatgaagctatatagacttcaagtaacagcatcattgctctagaactaggtcattcttggtctctgagctccggacaaattctgaagtgacctacatcattcatagaggcagaaggaggctaccattcattccagcaagcagggaaggctttcttgatatgtgctggtcccagactaagcctggaacacagtgacacacagtccttgccctcagggaactgaaagactaggaggggagggagtcatgtccataaattcaaaggccatagttgctgcaagatggcaatgagatgctaggagactataggtgggttttctagccaagtcttgggagaattcaggaaggcttcctggaagaggagacatccaagccaaggctgaaagagcaggagcccagcaggtgggtgggcccaggccatggacatagcatctccaggaggatcatgtgatccacccagactctcatctatgttgtttgcttttaccatgtagggtccctaccatttattttctcatatgagtgaagctgtctccttcaccagcccccacattatcatgtactgttttcatccagtcctctacagcctccccccaaccgagccccacagcccctgctgccaaagggattactgtaggctttgggacattctggactaatcccacgttcttcacccccttttatgtcagtcaccaggagaagctggtgactaaccacagttggtagctctttgtacgccataccttccccgactttctcttctgcttattttttctgtttcttgtttcacaatctgacatctcatgtgtctggaaggtcagctccatgaggtcaggaattgcctacttttttttttcaactgttgtacactcagcacctagaagagtacatggcatgcagtgggtgctcaaaacacagtgattgtgctgagtgcaaaggctcagcctgtaatcccatcactttggaagaccaaggggggagtttcacttgagcccagaagttcaagaccagcctgggcaacatgacggaaccccatctctattaaaaatacaaaaaactagctggatgtggtggtgcacacctgtagtcccagctacttgggagctcgaagtaggaggattgcttgagcctgaaaggtcgagctgtaatcacaccactccagcctgggcaacagagtgagagaccctgtcaaaaaatatatagtgattgaatgaatgagttatactgctaaatggtttaaacaattatctaaacattgtttatgttcttttgagactttgaagacattgactttcaaatccagtagtttccaaatttaatcatcagaattacttggagcactttttaaaaatgcccaagtcttccccccaaaactcttggagtagttacttcaggatatgcgactctgagattttggttttgattcagatataatccaggcattgggaccattttgcaaaggagagagtagaccagagataatgagtgcattatctctgccagggtctgctggggagaacctgccctgatgcccaggccagcgtgctctggctgcctggcttatgtctaacaggagctggagggcatgagggtgggacgctactgttcacatcacagggaagatgtgaatgggggtggtttggggtggagcgttgaccaggcttttaagagaactgtgggtttatgcctggtaatgataaaggaaagtagatttcaggtgcagaaaacatatccgttgtcatttaagtaaagttagaatcataggtctgagataatttaatagacttttccatttgtcaaagatgtatgtcttatttcccagtgatctctttccttctcaaatatacttgctactacaaatgacattccaagagcccatttcagtcccctgagcgttttgatttttctttcgagcagtagacctgctgtagtttaagctggttgggaaagctgtcgttcaccttgatggattaccgtccccgcagtgagcacccagtctccagaaagttcacggctccctcaccttatgtatctgatttatgtagaaacgtcgataaattagttaggagggcattcttgctgatatcagcaatcccagagcacctgggaggaaagcagagtgaagattttgaaagtcacaggcgatgtcggccactctcctgtgtggcccaggaacctcacacaatgataagataaggaagtttaatggatggtgctgccttctgaaagattaatcgtgccttgaaatctagatattttcatttcaggctgaaaacagtaaattagaaattaataaaaaggagatgatttcatcagctcaacaagtgcttctgatttcaagaagttttccttaaattttttttttcactgctgaaaaaaatcagtgtcttgataattttatgaagtagcctgtaattatttcactatggctttgcatctgagaactgaccatttgtgttttgaattcatgtcaaacaataatatattcgatagcattttatgatttattttagtgcctaaatatttataaaacaaaggcagggttttttattttcaaatttatgagctagataatgtcttgaagatgtacaacatagtatactaattttccttgcattctggcagtcctcaaaatgtaataggcaagtttattcttagacaaaagcccatttaattaaaactcacacgataactttcatacatagcaattgaattattcctaaaaggattaaatacctaagctttgaagttggatgggtgattattacaaaagccagattaatacaattgacctaatttctagtcagtgacattataagcagccttgtaagaatagctgttactacaaatatgcgggtttgcaatgttcaattctaaagtggtctaatttgttcttactacctgccagaatgtatgcattcaagtgggtgtcctccatgacagctttaattggtagtacaatggtatgagtgtggaaaggagctggtatttttcctgtttattcattaattgaacaattgattggtcatctactgcatgccagttagcttattaggggctcagatgcaagtgggggaaggtaataatcaacaaggaaatatctgtcatgtagagaaataaaggaaggtagggtggagggttaaagtaagacaggttcagtattccactggggatcagggagggctctcacttaagtgaggtaggttgaccatggattacctgggggcagagtgtgctcaagcagcacctgcaggccacagggaggctttgagttttgttctgagtgagattggaaggtgttggagagtttgagttttttttattctttgagattggaaggtgctgggttttattctgtgagattggaggtattgagtgagattggaaggtgttggagagtttcaagcagaaaaactgtaagatctgcagatgttttaaatagatgtctctgtaaattgtaaaactgtaagacatgggtaagaagcaatcattttcaggggtgagactgcttgtaggacttcacatgagcaaacgccaggcagagtgtggaacctggacccttcaaagagaaacgcaggtggaagaagcagcaaggaggaacggggcttagctgggccatcgccgccgtcttctctggcactgcccctgtgttttccgttcagagaaaagcctttcctagcattcatgacccccatcctgtatcatccaggttccacacggtcctcttctgagagaccctcccgactactcctgtgcccgttgccatgccatttgttggatcacttgcaggccccgagtctcaaacacatgatttatcatcagatcgtacagtcgtcagaagggtcccaccgtttctaaccatgtgacctgggcggttgctttacttctccgcacctcaatgtccttgtctgtaaaatggggcggatcagcccacctactgtttgggattaaatgaggtgatgtgcataaagctgtcagtgccatccctgggctgcagcgggcgttctggaaatatcacagattaccatcactgtccgccgcgcggcatccgtatgcccttgattcatacacagtgccacgcgtgggggcggttctcagtcagaaaataccaagagcagccgccgcatcttagaatttgctgtgttttactcagtccttttggggtgtcagcattttgttttctgtgtgttggcagttgatcggtaatttccaccgatgcccctgtacctcctccatccccagtcttcccagtctgcatggcttcaggtgtcacttctgggttcatgtctgctaaatttatgttggtagttttagactctcctaatcccctacttggcgttcctcatcattggtaggcacatctctgaatgtgcgtctttccagacccaaattcagctcgtcttaaactgtactcctcttaaaacctatttctccttaattcaggttacagggaacactgcctcccttagtccatcatttgggcagcttcggtcaataaccctcccctgtggttcctcttctctcagatttcatcccctctgtcctgatgaagcccctgcttctagcctctcaccagctcctcttgttcatcttggctatagatgcttatcagcaaagatgttggttcttcccaatggtgaggataaagtgtgggtgctgatgaaggcaggatagtgacctgatgtagggttctctgggtaaaacacaatgtttaggattcccctctagcacaaggttgctttaggtctcggagatcagtgcaccaagagaacagcaaccagcagtgacctctcctaatgacagtggtcatactagtatgaccatattaccagaagaaagaagagaggttgttttttaaagcactggagattccatgtcagaaaatgtgctattctggccgggcgcggcggctcacacctatagtcccagcactttgggaggctgaggcaggcagatcagttgagctcaggagttcgagaccagcctggccaacatggtgaaaccctgtctctactaaaaatacaaaaattagctgggtgtgtggcacacacctgtaatttcagctactcggaaggctgagacaggagaatcgcttgaacctgggaggcggaggttgcagtgagctgagatggcaccactgcactccagcctgggtgacaaaagagagactctgactcaaacaaacaaacaaacaactgtgctattttaatagatattcaactaagaaatgggtgggtgtaagtgatttaacctgaacccatctcagcagaaacctcagttgatgaactttttcttttctttttaaacccactttaagaagaagtacatgacaataccgcagcccctggaggttatttcatgcaggtggagagtggattcaccacatcctccagctctgagaccggtgttcagtgagaggtggttgtgggctttgagtctgtgagatcttcagtcatccaagttggattttgtttatttgacttagggtagatgttggaccaatacctcgtaggaaggtttttgaatcgggagttgaagcaaagcagcatttcttgttagtcctcagttaattagaaaattaaattaactacaatcctcattcccagagctttctgggtaattgatgtcttactgtatttggattagagaaggccccaggaggcacaaggttataattgtgtagaattagagaatctagggaagaaggaatggcaggtaatttgcaaaatttcaaggcagggggccctccccaaagtcccatggcaaaggcattgcttggtgagcacgcggggctgggccagaggctgcctactcgggagacatcagctgtgggtcaagagctacttaaaagagaattcaggagatcaaagtattgtcttccaccattcatcagaagaaaatacatctagatttaaaccctggaattagactggcttgatgcttttaatttgcatttaaagtcttaaactttttcttcttccaaatatttaccattttctgtagtccttttaagtatttggactagacttatttagaaatgtacagagtgcagaacaatgtagactcttgagtggctaagagtctaaacggctgaggaatgtagatcatttttggacttaaaatgaagctttaactgcccccaaatggaggacctccttttctggaagcaaattgcaatctgaatgctctgtgctaaagcttaaagcatagcaggagaaactattagaatttgtatagtagcattgccttggacgagcctagtgcaaactgagcctggtatgtggaccaagtactgtttatgacttttctttaagcataagttactcagggaaagtattatcaaaacaaatttggttataattgtcttcagacttgtttttctgggacttgggacttaaaagaggggagtaggctgtggataagctttggagttggcccacacaatggagattgttcaatttttttttttttttgtcctctcagacccagtaactttgggatttttattgactacttttttctccaatttttaaaattatggtaaaatatatataacataaaattgtccatcttaaccattttgaggtgtataatttggtggtattaaatgcattaataatgttgtatgatgattaccaccatctatctctgcaactcttttcattttgtgtagctgaaactctgtacttactaaacaatctcttcattcctccctcccccaatcgctagcaaccaccatccaatgttctgtctccatgattttgactactcttaagtaccttgtataagaggaatcatcaagcatttttctttctggactgccttgtttcacttaatataagtcctcaaggtgcctccatgttgtagcatgtgtctgaatttccctcaatttttagtctgaatagtattccattgtatgtgtatgttacattttgctcatccatttatcagttgatagactcttggtttccatccatgttttaggtattatgaataatgctgtataccagaagtggaattgctggatcatatggttatttcatttttaatattttgaggaaccatcatactgtttgccacagcatctctatcgttttacactctcaccaacagtgcacaagggttcagtttctccacatcctcactaacttattttctgtttgtttgtttgtttgtttttaacagtagccatcctactaaagaggatctcattgtggttttgatttgcatttccctaatgattagtggtgttgagcatcatttcatatgctatttggccatttgtgtaccttttttggagaactgtctatttaaaagttctgcccattattgaattgagttgttttgttgtattttttgagttttagaagttctctatttgttaattccttattacatatatatatatgaattgcaaatattatttcctctcctgtgggttgcctttttattctattaatattgtcttttatgcaaaattttaaacaatttctcgaagtcctatttgtttatttttcctggttgcctatgcctttggtgacaataaatcaatgccaagaaatcatggacaaaccaaatgtcatgaagttttgccctgtcttttcttttaagagtttcatagttttagatcttacatttaggtctttgatccattttgagttaatttttgtatatagtgtaaggtaagggtctagctttattcttttgtatgccaatatccacttttcctaatcatttgttgaaagaactgacatttcctcactgaatgattttaggacttttaacaaaagtcatttgtccatatatgcaagtttcttggctctctacttaatgcattgggattgcgatagagatggtgttgagtctgtatatcactttgtgtggtgccttacttcatttgggctgctatgacgtaataccatggactaggtagcctctaaacaacagacatttatttctcaccattctggagtctgaaaagtctaagattaaggcactggcagatttcacatctgatgagggtgtgtttatcatagatggtgccttctctctgtgtcctcaaatgatgaaagggacaaacaggctctttcaggccttttgtaaggtctctaatcttatccgtgaacattctgccttcttgacctaatcaactcccaaagtccctcacctcttaataccatcaggttggaggttaggtttcaacatacaaattttggggggaaacaaactttcatattgtagcgggtagcattgacatcttaacaacattaagtcttcccatccatgaacatgggatgtgtttccatttaattatgtcttctttaatttctttcagcaaggctttgtagttttcattttacaagttgttcacctccgcggctaagttaattcctaagtattttattctttttgatgctgttgtaaatggagttgtttttatcatttccttttcagattgttcattgttagcatagagaaattcaactgaatattgtgcatggactttgaaattttgcagaatgtactgattagttttaacaggattttaaaaaatgggatccttaaggtttttatatataaaattgtatcatgtgtaaacagatcattttacttttttttctgatttaaattacttttctttctttttttatttttggtctaattgttctggctagaacttctaatattctgttgaatcaaataagtggtaaaagttggcatccttacgttgttctctattttaaaggaaaatatttcagtcttttgtcattgagtatgatgttcactctgggtttttgtatggattttatttattttgaggtagttctcttctatttctaatttcttgagttttttttttttttaatcataaagcgctgttgaattctgtcaaatgctttttctgcatcaattgagattattacattgattgctttttttaaagtccttatgacttcggaagagaatatacttacgaattgttatttttgaattgacctgatttaactctccagtcactcaaataatggcacaaataaaaattataacaatgattatgtgcttactatgtgcatgacactgtgcaaaacaattcatgttcattatgtagttactactcaaaatacctcctaggtaggtactgctattctttccattctacagatgagaaaccagggctgagagatgttcagtaacatgtccaagccaccaggccaggaaatagtgggactgtgatttaaactctatttaactcctgtgcctgcacttgtgagagctgtgctacacgtgtggacaggacccttattctaatactgtggagtggaaaggaaggaagaaagggagggagggaaataagtataatgatcctcttttcctataacttcagagagagtaattgtccagctagcaccttcctgaaccaagggaatgctatctcgtgctcatattgaaagaaagataaaaagacaatcggtgaaggattgtaatgaagattaaaggagcctggagcacaactttggtttccctgatatttttcattacacagagttattacgtgttagagcacacacaaagtgtattctcggccaggcacagtggctcactttgggaggccaaggtgggtgaatcacctgaggtcaggagttcaagactagcctggccaacatgccgaaaccttgtttctactaaaaacacaaaaaattatctgggtgtggtggcatgcacctataatgccagctactcaggaggccaaggtaggagaatcacttgaacctaggaggcggaggttgcagtgagctgggatcgcgccactgcgctccagcctgggcgacagagcaacactccatctcaaaaacaaaaaaagtactctttttttgcagaggaagaacattataataaatgatgaaatctatgaaacagaatgaaatgggacctgcttttggaataatctaatgaaatagattattttaaataatctagtaagataaattagatttataagataaatttagaagataaatgtaaaattataagataaatttataatataaattagatttataagataaatctaataagattattttaaataatataaaataaggtcaaaatgaaggcacttctgatgttttttttcatgagcattaagcagtgcgcaccaactgaactctagtataaagtggcttaccagaattataaaaagactgcacatgttcaattttaatctatatcttatgaaaatggtaatggaagagacaatctgcctgagaaaggaatagaagaatcacattttagttttaatttctcattgataaacctcctttagaaacgagagagtattctagaatcgtccaattgatagaaaataatgtatttccccaaatgcaatgtctttgttatgaagtcacacctgcactattgaataaaatattatccatgttgtgtgtgacatgatttcagtagaataaattatcagtgaatgacccacaataaatcatatgcctccacttcatgctgttaacacttcatgctgttaatacttcatgctgttaacacttcatgctgttaattcacttctgatggggaagctactcaaattccgatggaaatgttgatgttgcagcatttgggatgagttctaatatgtttgttcacttttaaacactcctgagatgtggatgaagaagctgaccagcaggtgtgtgatacatttgtttgcgctgtgctgtactgggaggaaagaaagcagcaaaggtgtcttctctaataaacaccactctttccccttctagatctccaaatctttctaggtcttggtgcctttgagcctttcagtcaatcttttaaataaaatggtttccaggtgtttattcgtgtcaatttaattttccctaaaaatacatttctagatttttacccaaccactgtgatgccgtaaaatatggcagaattctgggcatggtaaaactgttaggaagaatcagagcaccaaccctagatgtacataatgcgtcagggtgtgaggttgagggtgttaatgacactatattgagacagtatattgagcatctgtgaggcacaggcagtcaccagatgttgtgcatatgtagcttgttagttttgccaatacctctgtgaggtactcatttttaagcccatccctaaaaatgaggaaaccgaggggcagataatttaaataattgcctaagatctctcaactaattagtaacagaatttggattcaatccaagatgatcttaactctaagcattagcatgctacaccatcacactgccagatttacctttgagattcatttgtaggttgtatgcagtgatagtatcgcctttgttcatttgcacatcaaagacttcgtgaccaatctgaacacccttgtatttgggcaccaatgtgatcataagaagaaaacgttatctgccatcatcctatttctttttcctttctattttatggtcatatttttttctccatttcaagtagagggacatccttcatattttctctctctctctctcctggttatgctgttttcattttgcaaagtgaaacacacacaactagcagaaaatgaggtgtgccaggtgcattcacacatcacttgtctcccagagtaccagactctggtgtctcagaggcgtgattctcttgaggggggaaattatgttttgcagaccttgttcatttatcacttctatctatctcagacgttcttttcttaaaagaagcaagactcaggcacactgaaggtcatttccatgggacacacttgattgcttagaaaaacaaatttgaaaaatactttcttcagaaggaaagatattgtttctccagggtaaaatatttctgagggcttgactctttccaatgacgcctttatgtaagctgttggagcagggctcttaattgataagcagctgtgttaataattcacaatgaatagcatatttaaaacgtcaacccagtgttgattcttatggcagtatctgaggcgagagagaccaaagcaacaatgacaatgaatctttagattctggaaactcaggagaagccacactatctctagagtcaccaccttccttttttaaagaaagagggaaggttcccctctccaaaggaaagtttgcttcccaggtaaccgtgatctttgtgacctattactgatttcgtttaaacagagtctttatgttcaaatgcaactgtgtggtaaaatggccccagaatccagacatctagatcatgcctgtaacacttttcttaatttttgtatttatattggataactcatgcaatttttcaaagactccattattatttctataaaatgaagataatcttacctacacggttaacctcgcagaattgttggaaagatgaaatgaggcagtcatatatggattagaaattggaacctcctaaactccaatgccaggtgttagtttctttacatctttcttgtagtcaaaaaaaattctgggtaattgttttgagcagttatattgagaacatcctctgagaaaagaactgtgtgcatcttgccatggaaaagaagtctgtctctgcacgtaaattacctgatagggcatgagagttactgcagagaggtggatgcatgggagaacgcaggggtgggggagggacccatcagttggtgccttctgttctgccccatttggggtgtgcactttaaatggctaagaaaggatatcatttctattcaggtggagggtaggggtgcttcatggaagagactgaattttaacttagtcttgaataatagatacaatttactgaaatatgtatatatgaaaatatccttcaagggaagagagtttgccaaggtcaaacaggccgagaagtctaggtgtgttgggggaaggctgagaggtgcaccttggagggagtgcaggtgtgtgtgggaggagcatagagtcttgctggacagagacctccaggggcatttgaatactgctggaaattatttggtgtgtcctggaggtaagagagaccagggagcagtttgtctgtgcaggaagcagtggagtgtggtctgcatgccctggagaagccaaggcctgagggctctccttgcgggagacgcctcctgactctcactggccacagcaaagagaggtaggtttgctggctggaagcataaacacagccctaagtgccacatctccccagagatggcgtggagttcctctgagggaggacatggctccacgccatgttttgagcacaggtgaggcagtgacttatgagggacaatgaaaggtcaattcaagctttaggaagtaggtttggacccaagaatctttttaggtgatctctgaaattatgatcatgaatgagatcatgaggaaaggctccttggatttcccactggggccattttagcggctgcccaccagatgccatgattgactatgttattctttttatttggtgccaaccagagaatcattttatccagttcagatctcccattagtagctgatatgagtttggtttagaataagaaaactaactcttagccagataggcaagcatggaatcacacatacacatacaaaatacacctttggagatagatatttgcaggtaattgttttgaaacaaaatttttccatatattttgtaaaattttaaatttctcattgtatgacattttattataacagaaaagaaccatgaattcctcttaatgaagacctttcttgtcttcactgttattatcctaaagatatttatttagcatttggtgtagtgtaagatgaattgcacagctaatttaaatgtattactggctgggcgcagtggctcacacctgtaataccagcactttgggaggctgaggagggcagatcacgaggtcaggagcttgagaccagcctggccaacatggcaaaacctcgtctctactaaaaatgcaaagattaggtgtggtggcatgcacctgtaatcccagctactcgggaggctgaggcaggagaatcactcgaacctgggaggtgtagggtgcagtgagccaaggtcatgccactgcactacagcctgggtgatagggtgagactccatctcagaaaaaacaaaaacaaaaacaaaaaaaaaacaggtattactggctgccccctttggaaacagtacaccaaatttactgtgcctgattctaagaatagaaaattgaaggatgccttagagaagaaatagagacattttaaaataatgacaactttggaaaatagcacccagaatcccgtggcttaactttgttcagtacaaccccaaattattgatttatgattttttgaccctgagaaaagatgcagatgcagagaaaagatgtagaaatccctccccttcccctctcctcctgggagccacatagggtatgaaagtggtagagatcctttctgctgagccaatagtcgtctttaaaactctgggatccccttccttacaccttatacaaaaatcaattcaagatggattaaagacttaaacgttaaacctaaaactataaaaaccctagaagaaaacctaggcattaccattcaggacataggcatgggcaaggacttcatgtctaaaacaccaaaagcaatggcaaccaaagccaaaattgacaaatgggatctaattaaactaaagagcttctgcacagcaaaagaaactaccatcggagtgaacaggcagcctacaaaatgggagaaaattttcgcagcctactcatctgacaaagggctaatatccagaatctacaatgaactcaaacaaatttacaagaaaaaaacaaacaaccccatcaaaaattgggcaaaggacatgaacagacacttctcagaagaagacatttatgcagccaaaaaacacatgagaaaatgctcaccatcactggccatcagagaaatgcaaatcaaaaccacaatgagatgccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccagacgactataaatcatgctgctataaagacacatgcacacgtatgtttattgaggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaatttggaaatcatcattctcagtaaactatcgcaagaacaaaaaaccaaacaccgcatattctcactcataggtgggaattgaacaatgagaacacatggacacaggaaggggaacatcacactctggggactgttgtgggttggggggaggggggagggatagcattgggagatatacctaatgctagatgacgagttagtgggtgcagcgcaccagcatggcacatgtatacatatgtaactaacctgcacaatgtgcacatgtaccctaaaacttaaagtataatactaataaatttaaaaaaaagaaaaaaataaaaataaaaataaaaataaaactctgggatccaaaagacagactcagtgatagtttcccaatactgttattgggaaagcaataaggctgaataaaaggaaagacccttaaataaagtagaaaagatttgcatgtgacaaaactggaagcagagaaactttaaaagcacatacattttgttcaaggaacaactatagttcttagtctcagagggatttaggcatttgcccaagattatgatgtgtaaaacagagatgctaatagctaattatcagagttatttatatgactgtgtcaggtacctgcctgaaaatgctcaacactgtccatcagtaagtaagagcaccagagaatgactgtctcttttctttgtggttctaacgtgtcacccacgttagttccctggactcagcaggtcgccaccgtgaggccccagcatttgggtccatcactggcgatgtgctgctggcctcagaatgtctgcctctgactatgcaggaggttgctgtgtgatagagtgcgggggaatcaggacaccgcccaccgctgtccaaatgccaagtggcgattcaggtaccttaggaggaaaagggacatggtgaggactggagttgcggtagatgcctcctgggtgttgaagagtccgaaggatccagaatggcagagaggggaaatgggggcagccatgcatgaagacaggctggggggcgctaatgcagctttctctcctggagcctctcatctccacctgctgcggaagctcctgtgcatccaactctgggctgggaaagcaaagagcactgggcaatcacgcctttctctgctgtctgcacgtggcgaaaatgaaagcatttcatggaacctgtttggggcacgtgaagagtgggccagagtgccagggaggcagcaatctgcaggttgcgttcatgccgtgacagtccattcaggggtgcaggagctggtagctgagttccccttcctgttttacacttctggtcttttggttctcaatacctcggggtgtaaaggacagctctttatttggctgtgaatatccaccactgtcttcctacttctctttctttggaagcatttcatttccttttctagaaaatttggagctgaagtgctcggaaggccactgattttaagctcattaaactcacattcacctttgtcttttgttgaaaaaagttaatcttgttttccaaagggccacaggaggatattgtatggatgttatttattgtccttcacaaacacaccccagagattagctcattataggttttattcaacaaagtaattattgcagagaggaagctgagcttttagtgatggacttggaagtgatgggtgaccactctcactggactccagatagaaacagaaatcaaagccgctgtctaatcacacttcactcctccctctgcataggactgtaattggtactcaaggagaacactaaatcaaagatctcataaggcaaatattagcagcatgtatcatgtaaataagaataatgatcagaagctacgcagaggagggactattgtgctcaaaagcagtggaagaaatcataaaagaaagatccataaatgttccttgaagacaacaacattagactttataaaataccacacagaaaatcagaaaagagcctagagaaaatatttaccacaaataagaaggattaccatctttgagctacgggagtgcccatatgaatcaataagaagaaaattacaaaggccaaatgcataaacagccaaggacatgaagagatgaatggaagaaagagaaaataggaatgatgaccaggtcgaccagaaacattcaacttaaccagtaatgatggaaattcaaattaaggctaaaaggagacagtttgcttataaaatcagtacctatttcaatagttgtgattcgataaaatggactcctctcaatacttggtatggctgtaattggataaaagtgttctggagaggaaatcaaccttatgttgcaagagcagtaaaaatgttgatatgctctgatacagaaattccacgtctagaaatttattctaagtaacattatgtacagacccaattacaaaaaaaaatgcaccagtatgtttatgatagcaattttttaggttgtaaaaatagaaaaagacatccattaaaaattatgcttagaataagtttagtaataataacaaatgtgttttgtgcctatgtgtgccaagcgtcatacctacataaatatgtgtgtgtacacatatacgtatgcaaatgcatatatttatatgtatgtgtacatttctatgtatgtgaattttttttcatttgatttttcaccaaccctataaagtaagacccattattatcccagtttgtagatgaagaaactatgacttggagagtttattagctcaagcaacaatcatacacccattaaattacatagcgcttcctccagatcttcaggtccagatccagtgaaaaggaaatgatactaggtggaaatccctgtggtttgtttttggataaaagtttcccaatactaggtaaagatgttcaggtttaaataatgttttgtgacgtgcatgtactggtgttttgcttgtttttccttctagctacacatgaaaataaggatattttccttgttactataaaagtattacatattcctttaggagctgctttcccccccttgtttgtcgtctcttaaaaaaagcattttctaagcagactgagaaaggagtctattaacaagcaaattgcatttgtgagtaagctgaagtgtagggagtggtatttcccactggggctctggaggctcagctccccagtgcagtggctgaacagggccaggcagtgtgaggggactggagctgggcactctgctcagggggtggacagagaagggaacctgggaaggcccccggcaggcaggactcagaggctctcaaactgctctcagatctgcaggactggcttcccacaactctgttcatcctcctccatcgcaaaatgaatatgtaaaggttttccttttacctgccaaagacattttgggaaagtaatgtgaagatttgtactttgtgaatggactcatatttatgtgtacaaaagcatgcagcagtttaaggaatcctatggtgaatactctgatacagaaggaagaattatttgaaatgcgatgcgtaacataaatgacctttcaactgaagttaacttagatactggtacattaagttttctaagaaataaatataaataaatcttatattaatgctagctaaaggcaaaccgggaggcatgctgtaaagtctatgcaaaatctggatgctcatggagaagattcttgtcaaatgtcatgtattattagtataggtagtctcacccttctaaaaaaggaaaccagaagtttgccagccaacctttaaattttgaaaaggtaagtctacagtgtgcttttcatacggttttcaaaagcagataaacattctcttttattaaacacacttctcaatttagtcatggtttgtggaccaatgttttcttaaattatttcataataattttacaacactgagaactggctgtgaaatcaacctttgggaaaaattaggagtagccgggggatgcacacacgcatgcacacacacacacacacacgcacacatgcacatgcacacgcacacgcatacacacacacacatgcacacatacatgcacacacatccacgcacaaatgcacacacacacgcacctgcacacacacgtgggtttgcatgctgacttgacatccaatgctaacagttcaaccacatttatggtttcataaatacaatgaatcatgagtagacctctaggtcaatggttctcaaagtgcagtcttcagaccagcaccatcagccttctcctggaacttcttaggcaaattctgaggacccattccagactgagtcaaaaaccctggataggtcagttattccttactacctttgcaaaacaccattctgttttagctcatggtgatcaaataaagagcaggatgaatgccaagatagagtatatagaacacctgatatggtgttctttggatcatgaccacacatctgttcccagcaaaaaggaattgtgccaacaggatgcatcaatgcactcctaatcagtgtcacctgatcatccactaatagctcaggcaaacatcagcttttccatcagtacacaaatcagtcattattcttgcctctcatcttagtgacagtacttcattgccccagcctacttgtcaaatccattgtcctgttaattttctccacacactccagggagataacagaatctctgggtagcagaccccatctcatgcctctgatatttataattgtgctgccaacctcctcttccaactagaattcctccccatgtttaaatttccaatttaatttcaagattctttgagaagattcctccaagtcttccctgttctgaaccatgtataactcttctgcagctatcatttggttcatcatggttcccttcatgaaaatcattttatgcatgtaatatcttaactgcccaaatgttattgaaaaagttttgagaggaagaactacatctcacatgcctttgtatctttcagtgcctagccactgtctcaccacaagaagttatagtgttttctttgatgcctttaatgtagatgtagattttcgctacaacgattttgccaggatgtgtttaaagatattcacccttggtcccctttctgcagttccttggatcatgaaagatgtgtttggtttggttggcccttacagttcattttccttttgaatcccaatttaaaattttggatttttaaaaaatagaaataaaacttatggctttctttaaaataaaagaagacttagaccctaagtctgcatttttataggagttgatgaaagtttatgcccctttgaggagcatgtgaattccaggctgccatggttctcagcacttcctaatataccgtgtccaatatggagattgagttctggattattacctgcctgtagtactgattttcttagattggagaggattctccatcaggactgccaggtttctagcattggctttgcaacttactagctttatctaagcaaccttgtgcaagatatttaactttgggaacagtaatgatacctaactcataatgttgttatcatgagttaataaagtccttaaaaccaacctggcacttactgagtgcgcaagaggtatttgctgttgttgtcataattattgttagaaatagtagtaatagtaggaaattcaaatgtgggaagtaattctagttggaggggaaggttggcagttgtagtaatagtatttactaatgtttcaaggtagaaaaatgaaatatgaattaggaaagttacatgttccaagaaaaatgggacacatttattttcaaaaataaagaatgttcctgtattcaatgtgtaaatacagtgttttggtctcaaggagactataacttaagatgtcagctaatgtcactgattacctgcttgatttatgttgcttcattaaattcaagttagaaaagtgggttcattcttgatttcttttatccaaatcctactatcagttttatgtggttattgtttttttaaatcttttcaatatatatttttatattggaataatgttagatttacagaaaagtttcaatgatagtacagacggttcttatttaccccttacacaatttatctcttgttattaacattttacttttctgtggcacattagtcaaaactaagaaactggcattgatacacggctattaactcaactatagactttctttggatttcaccagttttcccatgaatattttctctctgttccagaccctaatgctgagttccccattgcatttgcgtgtcctatctttccagtctcctctggtctatgacagtttctcagtcttcccctgttttttttttttctgaccttgaatcatttatttatatcaacatttttatggattgaattgtattccccccaactcaaatttatatgttaaggccgggcctggtggctgatgcctgtaatcccagcactttgggaggccgaggctggtggactatttgaggtcaggagttcaagaccagcctgaccaacatggtgaaaccacatctgtactaaaaaagtaaaaaaattagccaggtggtagtggtgcatgcctgtaatcccagctgctcggaaggctgaggcaagagaatcacttgagcctgggagggggaggttgtggtgagctgagattgcaccactacactctagtctgggtgacagagtgagaccctgccaatttatatgttaaaattcccaatacctcagaatgtgactgtatttaaagattggtcctttaaagagataattaaattaaaatgaggtcatatgaatggaccctaattccatatgactggtgtccttataggaagagattaggacacagccatgcacagagaaaagaccatgaaagtatagagggagaggccaccatctataagccaagggcagaggccgcagatgaaaagagtcctgctgacaccttcatcttggacttctagtccctagaactgtgaggaggtaaattactgttgtttaagtctccaagtctgtggaatttattatggtagccttagaaactaattcaagtatggactcatataagtcatctttgaacttttcattacaatccaattctatgttgtttatatcgtggctcaaatgattccagctttgacgtggtctccctctcatgttggttcctctgtcctcttagcatgtacctacacttgtgatttttgggcacttttctgatactacaagatgttccaggtttgttttgttttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaattaaatttggtgttttcccttagagcttgattgatttgctagattaaaaagcatttaaaatcattgtttaacacatggaaaaacatattgattgttgcagttctttataaagaaaaaagtacagtttggttccctgaaaaatacatgaattcttttagctgactcttagaaattaagacacatgtatctacaagtaggtttgggccaagaatgttccctgccccaactccgtgaaaaatttccattacatcagatacttctaggattgtatattcccttggaagatcacaaaggacatccgtctccacctttgcttaaacctaagtgatctttataaagaaaagactctttaatgtttagtagagatgtcacagaagtagacatatattagcatctttaaatgtctgctcagatttttcgtaactctcattgcattcatcctcctcttcaattgttaaaaattatagtcaattttctaaatttcaagacaggatctcactcccattgcccaggctgaagtacagtgtcgtgatcatggcacttgacctcctgggttcaggtgaccctcccacctcaccctcccaagtagctgggaccacaggcatacaccaccatgcccagctaattttttatatttttagtagagaagggatctcactatgtggccaaggctggtctcaaactcctaggtttaagcagtctgcccttcttggcctctctaagtgcggagattacaggcatgagccacagtgcttggcctcaatttttatctccctagaatatttatgattctttctgaatatcagttgcaaacccaaatctatatgataactaatcttccagaaattctaccccacaagacagagtcaactgtatacatgaagacatttatgaactctgttttcttttaggctcaacgatacttcttggcatatttttaacttttgtttataggccgttattaattttgaagtacctggtattgcttgtgtggaaataaatctgcattcgagtaattttaactctatgatttgggcgctaataatacttattgcaagagcatcctgaagtagtctcgggctaggtaattcatctagttcatcctcttcgtttcaggaaagtggatttcctagcctattcaagcagctatcacaaaataccccaagcagggtgtggcttagaaacagcagaacttgacttctcaccattctggagaccgagaagtccaagatgaaaatgtatttggtgtctgctgaggggtcactctccaacttcaatagcacctccttgtcaagtcctcgaatagtggaaggggtgagagagctctgtggggtctcttttatcagggcactcatcccattcaggagggttctgccctcatgccctcatcacctcccaaaggccccacctcctaatcttgggggttaggattttgacacgtgggaaacaaaaacatttgcccatagcaggctgctgggacagaatacagttcaggggctgcaagtccaaagccaggtgccagcaaagtcaaagtccaaaggcaaatgaacccagcagggctaatctccagcaaagcttctctgcttggcttgcagaggccagcttctggctgggtcctcacctgtcctttctgaatgcacgcactcttttggggtctcttcctcttcttttaagaacagtgccctattggatcaggcctccccacctcatttaaccttaattgccttcttagaggccccatctctaatgcaatcacaatggcagtgggggctagtgcttcagcatatgaattttggagacacaattctgtccataactgtaggtttttggttatctctggaaatggaaatgctttactttctaatttcccacaatccagagaagcaatatctttttttttcaactttagaaatcttttgaagttttgcattgttatacagcacttattcaatgccgcccaatccgagtgacttcatctcactcgacgacctcacctgactattccctggcctctgccctgcccagggcacacactgtggcaggtgagtgcttgtgcatgggcacacaaggcagatgcctgggtgttctgggcgtgctttttgcctgagatgttccatgacctggtctggtgtctcacaaagcctcctcatgagaaacacctttcttagggaaataccttgtgttgctcttttagaagattccacatgtggtccaagaggcatcagcatcccctgggagttcatgagaaatgcagctcagacccccatcccagccctcctgagggagaacctgcacttcttgagattcccccactgacctccaggcttaggaaagtgagagacacgctgccctaaagtggtcctcggtatagattcaaggcagctgcccaccccagtcatccaattccttgggctatcttaaattcttttccagtctcttctacttagtttaaataaatcaagtcacactttttctccagggactcatttccctcaaacactatatctgatgtttctgcacctactgggtttttatgcagttatgcagagatcacaggctgtttctatggatctttgcatattgcaggaatctttttgatagtgaggtaatttgtgctgaatcaaaaggctgacatgcaaagagagtatggtggcgtgtactaaaggctttatggtaatttttgttccatttcaccatcttttattcatatgccattttgatttttctagagcgaatatataggatattatctgaatccattttctcaaagctacgttttaacaacatttagtttgggacatttatttcgtattgaacacacaaaatgtttgctaaataaaggcttcaaatagcaacccctcccctgtttggtattttttcattgtttatcattggacttttagaagtgtaaataagatgtgtgagtcaaattctttctttgtaactgcttgaaaaattcagtaaccaattatttataataattggaaattaaatgagaatcaaaattcccagtgagtatatggcaagtttgttatttcctttctaccaataatgaatgataatgagtcaaataaaagcaatttgctttttcatgaaaagtagtgatgattattttaacaatcacaaaatgctttcctgaacatgttcttttatcatttctgtagtattgaactttaaaaaaagatatcattgagaataagtgaagcatggaacctgtaaattgcctgtttttgaagccatcgtgtccatcatttttagtgagagaataatgttctgatatctccacttgacatcttagactctattgtgttataacttcccacaacttgccaaagggccattctaaacttttgctcttcaatcggccatcattacgggaatattggcttccaatttttgtgtactaatatgaatttggctcatgaatgttactactccgaccaacaaaattcaaatgctccacaaaaagagaagagcctgtctagcacaaagatcttttcagcttttgagtttcctcttccctatcaatcatggggtttaatttaaattaaaaaggaaacattctttcaagatacatagtgtgaatcaatcaatcaatcgtacagtcttcctttacctaaattaatcacctttataatccttttagtggttcttgatctcttataggatacaatcaaaattccccatcttgatatctaaagcttcttaagctgaatcccatctcccttatcacttctttttatcatctctctctctactttcctttacacatattctattccaaataacctacatgttataccccaagccttactcagtcattcctcagagctgcgtttttatctgtggttacaaaacagatctgctgtcagaccagtcctgacttgacctttctgtgaggttgccatcaggtgtcggctggggctgtgtcttctgaaggatagggctggatagggctggaggagcctccacctaactgtcccccttgtgtggctgtcaagttagtgctggccccacacaggttgccgaagggtgctcacggcatggtgcctggtgtcttccatagagatacacgagtccaaatctgaagctctggtggctttggtaatccagcctctgaagtcacacactgtcacttccagtatgttctgcaggccacttgtagccagccctgatggagtttggaagggagtgagtagcaagaggcctgggtcccaagggtcatcttgaaggctggccactgcagggcctttgtccataccaacaaagctcaccctggcccatctctgcatgcttccttccacaccctgatagatccttcttcctctaggagccttcctgacccactctagattgaagcaactcaccacacacctgaaaccctttagcacatactatctagaccaagcaggtggtacatgttatattcacatgtagaagactcatccctggttgagtgacactctagataaatcactcaaggttccagctcttaaaagattaccttccatatggtggtatgaacagagattccctaatgaccactactcagaattaagaaggtaaaatatgccgcatataatatattcaattccttcaacactgtgtggctttggctaaagttaacttgccttcctcaagcatgcttaaatttggtgtgagtagtaggtctgtggcaactttgcagagttttgtggagaatttcctattacaaattctctaggttgtgagctctgcggtacaagtggctatgtgagactaatgagacattaagatcctgtttaaaggtgcctgtgggtccctgagctatcttgggctcccttctgaataagcaaaagggattaacttgggctcagtatgatgtaggttaaattttgacccagcagttgaactcttttagaagaataaatctattgatagtagcgttgggcagtactctgtcatctagaatgccccattttctggccaggctggagaagtgcattttcagtactggaaagctgagtcattttccccgttacagattgagttggacacctcctttgaggcatccaaaaatgacagggatttcagatgaagcaaggctagaattgtactcgatggacttgaacttgaacctgcagcttctcaccctccctgctacaacccttgtgttggagttgcataacttctgggagaaccatgccagagagttatagtagtccccacttatcctcagtttcactttctgcagtctcaattacctgtggtcaactgagatccaaaagtattaaatagaaaattccagagataaacaattcataggttttaaattgcacactgttctgagtagcattatgaaatctcacaccgtcctgctccatcctgctccgtcctgttctgggacatgaatcagtcctgtgtccagcatctcaggctgtgtacaccaccctcccattagtcagcaacatcatcttctgacagccaaccatggacatcatcatgccgatgattcaggatcacccaagcagatgatcctgcttctaacctattgtcagaaggtcagtagtaagctaacacaacacgatgcctgtgtcattccccagacttcatctcatataggcattgtatcatctcagatcatcacaagaagaaaggtgagtacagtacaggaagatattttgtgacagtgagagagagagaaaccacagtcacataacttgcattgcagtacattgttatacatgttctattttattattaattctaaaaataaaatctcttactgtgcctcacttataaatgacactgtatcatagctatgtatgtataggaaaaacagcacatatcaggttcagtgacatctgcagtttcaggcatccactgggggcatccccttggcgtgtattctcccccaccaaggatcaggggagcaattgtaattctctgctaaattctagtctgtcaggatacttagtgtttacgaatttgaataaatatgagtaaaaacgaattatagaaatgcggttttcctgctttcaagtgcaaacattgacctcagtggacaactcaggaaacgtttctagatccagcttctaggaggcctgtggctagctggctccctctgtatgcaaaccattcacatgcaaaatctcttgagcaattcctgtctaaaaggggctcataggctccgtgaaatcatgtttacagtttcaccttgcttaccaaggcctttttggttctagacaaaaagtctattacaacccatgtcaagctgtgatattattcaaatcactggagtctgatttcaatgatcgttttctatgcacagcttcaggatactcagcctatcacccaggaggtgaatgaagcaagtctgaggtgtctgggctacttgactttcgggtgatctcagggaacatctccccaccaattactttcaagactgactcgctgacatggaaattccttatctggaatggtttctgtctgtggttgcaatgcttttccaattttcatctacatgaaactctcccagaaatcttaaaatgtagtttttgttgcagtaggtttggggtgatggccccccatgctgctagtccacgtaccaagcactggaggtatttaaatgcacaagcccctagaaaaataatgcctgagactttctaaacggaagtcctatctgtagctcaggccattcccgtaagccccagcctgtgaaggctccctaggcacctgaggtgggctaggccctgacctgatttcatgacttctcccttgggtttttccctccccacctcccaccccgctcccagaagcgaagagatggcttcaccttctttactccctgccttgggcagtggctccaacatcttcacactctctcaagtcggacagttcattcatcttatttcctcactcccaccacaagtcagttactctgtcctttggatggtgatcatgtgcatgatggctgtgtcatgtttcccatctgcatttagtcctccccatcttcatggctactctgtgccagctactctgtgccaccctcatcgcctcttgcctaaactcttcaaaccagtgcaaaagcgacctcttatttgcttttgtaattcattcttcactgttttgccaaagggccattacaatacattgacagaatattattacccttcctcaaaatcatttgtgtctctccatggccaaaaccctttcacaagagatcactttgataaacaattaccacctgctcatagcctataatccaaccatactgggaaatgtatcctttagtagataggacctgcatttgcaggagtctttgtctcctaattttccttcagccagaaaccatctcctcctccagcatgccatagcagaacctaaaaagtctgcttcccttctaaacttctgtgtcaatttcactttctgcaggaagccaaccccaattccaccagccctgttccaaatcaggaaaacctgccccaccttgcctgccactagctctggctttggtagcatccttttgttctgttagtgttgttcacttaagttcttcttacaagattgtaaattttgaattacaaaaactttgttttattaatctttgtttctcctaagtcagccagcaaagaaccttgtttacagtaggtgcttaataaatatttaatccatttatcaattgaatgcaagcgtttcttgagtgttttttcttagattgtgcgaaaggaaagtgtgaaagatgaaaggaaatcccataatgaaataatgaaagagagtggacaggggacggctggaatagctgatgtcaaatgtacctgaaacacagctctatctgtgagtcctagagggtaggaaataacagtgacctcataagaaaccattcctctccctgctccctactttacaaccagattatattacttctgccctccttgggaaatgctatgttaaatgttatttttctgcaatttgtaatgacctttatatctgaaagacagttcctataaaaacatgagattgagaacccatcaaacaagtatctctaccatcaactaaaataagcaccatggacccttcttaagaagtgagggtctcatgtttcaggacaagcgtgttcaagtaccaccagccaggaaggccaaccagggcaaggctgtgcattccagaccctccagggctatggcgtcaggcacttgacctgtgttttaggcaattgtgagttaatggaaatgatattagcaatcataggcaatgactaatatttaccaagcatttagggaattggatcagtgactgctggaaatggaatacaagaattaatgttccaggaattaataatgatcctcagaaaagcttatggcttcatccacaggcttttgtcattttagtattaaaggcaaagcaatgaagagactgtggctcattcctctttccttgaatgggcgtttgcatgtttcaacacgctggaaggttaccttcttaaaatgccagctcattattcgtgtgaaagtgatcatacattggtattaaatgaagagtagaggcttatcattttagacatgatgggtatgctttatttacagatagtcatccttccaggagttaaattcacattgactattttttaaaatagtgctcacagcttagttctggatatgtttgcgttttccatctctcttggctgcttgagaacagagcgtccttaggaaaggacaagtcctgtgcagaatgcgttctcctttctcccacatttgcatttgcggggagaggcgtgcctgctgttgtgcacttcaccagcgacctcccacacccttggttctgccctgggcttgtcttcctttttctttccttctcttgaaggggttacagcccgaagcctgaaggaaaccagtctataaaactggtgaacgctgtctggatagagagaacagccctcgaattttgaagcgcagtttgtgtaagagtttatgggctctggatcatctgatagttctatttttagttttttgaggaacctctatactctttttctcataacagcagcaccgttttgaattcccaccagcagtgtgctccagggtgtttccaaaataagtgaaatcaggatgtcaaagagacaccagcacccccatgcccatctgcagcaccattcacggcagccgaggtgtggaaacaatgtaaacgtccattgaaatgtggaaacaatgtaaatgcctttgacggatggttgggtaaagaaaatgtgttatgtacatacaatggaatattattcagccttacaagagaaggagaaggccggcacggtggcttttgcctgtaatcccaacactttgggaggctgaggcaggcggaccacctgaggtcaggagtttgagactagcctggccaaaatggtgaaaccctgtctctactaaaagcacaaaaattagctgggcgtggtggcgggcacctgtaatcccagctactcgggatgctgaggcagagaattgcttgaacccaagaggcggaggttgtagtcagccgagatggagccactgcactccagcctgggcaacaacagctagaagagagaaggagatcctgccacttgtgacaacatggatgaatctggaaaatgtaatgctaagtcaaataagccagtcacggagggacaaataccgtgtgattccactcataggaggtatctaaagtagtcagactcatggaaggagagaatagaattgtggttgccaggcactgggaggagggaaatgaggagttattaatgaacaggtataaaatttcagcgatgggggtgggtagggcatgaggaaatacagtcaaaaaatgcaaagtttccatttgacaggaggaataagttttggagatctattgcacggcatggtaactatagttaataataatgtgtatttcaaaattgctaaaagagtagattttaaatgttctcacaacaaaaaataagtatgagatgatgaatatgttaatcagcttggtttaatcattccacaatgtatacatccatcaaaacattccactgtagcccgtaagcatattcatttactatttgtcaattttttttccaaaaaatcattatgcaaaatgagtaagttctacaaatctgctctacaacattgtgcctatagataacaatgctggcattttgcacttaaatctgttaagagagatgatcttatatgaagtgttcttaccacaataaaactttaaaaaataaaaataataaaataaggcaaagtttaaaaaaaaatgttcgtgagctctggaactaagcataccaggattcgaagtctgagtctcccaattactaagtgtgtgactttgggcacccacgtcacgtctgacactcagttctacatctgtaagtgaatataacaatgcctaattttcagcatcattacaagaagtatagatcctgccgcagggtcttgcatggggcagtaaccagaaacttgtagctactgttgtgtgactgccatactgtctttggcccttgtaagctatgtgattttagacaaataatttgcatgtcagtttctttttttttttttttcctttttttgagatggggtgttgctcttcttacccaggctggaatgcaatggtacaatctcagctcactgcaacctccgcctcccaggttcaaccaattctcttgcatcatcctcctcagtagctgggattacaggcgtgcaccaccacgcccagctaactttttgtgtttttagtagagacagggtttcaccatgttggccaggctggtcttgaactcctgacctcaggtgatctgcccacctcggcctcccaaaacgctgggattacgggcatgagccactgcgcctggcctttgagtgtcagtttctatgccttagaaagaggggattggagactggatgatctatggggagggtggtctaagactttgatgtgtatgagttgtaaagtaacataatagatccaaatgacaccaaaagcttttgctgaacccagtcagttgagtcaaacaagtcattagtggagaacggaaccagctatttaaattaaacactggcatgtgcctggtttattacagtggccccagtgcccagcatgttgtaggcactcaggagacatttatttaatgattgaaaagcatcagtcagagctacaggacatagaaagcacatttgaaacagttgagaagatgtaatgaagtaacaacttagtaaagaatggacagggtcaggaaagcaggaaaacgtggtgaaacattctgggattagaatcgcaagaagttgctaccaccctttggcccaagggagcagttagtgaaactcagcaaatgtctgtagttacagagaaagaggaaggacaggatctgtgggaataaatacctgaattctctcctgactttttgatctcttggtcaagcctcaaatctattggccaaacctaactaaaagctggagcacaaggaaatcaggttgaggctggtctgcagaggtcactcttcctagacaaagagcagatggaaaagggagcaaaaaggatctgcagggacaagtgaagaacatacagcactctaaagaagcttcccatagaagcaaatttgtgtatgtgggtgggaactaggatattttatttgtttggggatgcttttattacaggtaaaagcaataactgcatattttggtctgagatgtattttttctactaataaaattaataggctaataagggcaatgatcaccttcaaaaaacacacaattttcgctagttaatgccaggtctgatcagcacattttagatggatggatggttgaatgggtcaatgggtagatggatggttggatggatggatggatgaggaggaggtggtagatggataggtgaatgggtaggtggatgggtgggtggatgggtggatggatggatggtgagtgggtgggtagatggatgggtgagtggatgaaaggttgagtggatgggtgggtgggaggtgggtggcttggctaagttaggattgctacctttaaaagcatagcaatggtaacatagagtatcggccaggcaacaacatttagccagaaaagacagatccagagcagggtctcccagctggcttgcaataaataaattactttttcgtaattttgtcaaaaacgttcaatgtgcttggttttaatgaccaggaaatatctagctgtgttgaagccccccatctcagggggaggtattacctgctgatggttctcggcttgttgaaagttcacatcctaagagtgtgtgttgttgttagtgtgattacagaaaatctgcgccctctttctaacctgtgtcaaagataaacaaggcatgacacaaggtggtaagaacagattttaatcagcaacaactattgcaatagggaaaagaatacaacgtgaactaaattcaacttccatttgtacagcagtgactgggcatttataaaaggagaaggaaggagtggagagagttaagcaggatttagtagagtcagggaggtgaaaaactccgagggttagtcatgtgataatgtcggtggtgtctgcgaactggcaattatggaagttaggattccatcctcccacagagaccagacacagaggctctgtcctcaggtgtcagctggaacaagtcataagctcttttggcaggtgtgacttttctctggcaggcacttctggttgggggacagccagggccatcctaggaatgtgaccttgttctgttagaaactgtgctagtgtttgttcaagtctttatagaccgagcttaaggcctagttaaaaaaggattcagagaaatctgactcaagtttggtcaaagagagagtccttgccaattgttattctttaggcatttagatatctctgaatacccaaacagagaatacagacaaaaaggaataagcaaactatgttgtcaaggaacagttttattgtcaaaatgtatctcagtgatgattaatgaattggaaagttataagatgcctctattaatcacttttctaaatgagttgagttttgcagcacagctgaaaattttgatttcattgtttaaagcaaattttggaaagaactattgagtgcaagttaaagccggaaactcacagaggcaaagaaacatagaggatggtctgttcccctactgccatagactctataaagagcttgtttcacggcctttgttttcaatgttcctcctatggaaaaaataattgccagttttcccaccaatgtggacacatatatgaaaattttttgactcttcccaatcatttgtaaaaatgatactatcctctcctgtttttgcacgccattagagagatgaggtgcaagtgtaccataggcctagaaaccttgcaatgtcagctacgcactgtttatctcaactcacatacgcagatatttgttgcagattagggtgttgtctgtaaagaaagaaaagtgttcaaagaaaacctgctaggtgatgtatttgttttcgcttattgctgttacaaattaccacaaacttagtgacttaaaacaacataaatttattatcatatgagatccaaagtctgaaatgggcttcaagtagctcaaatcaaagtgtctgcagggctaattccttctggaggctccagcagggaatctgtttcctgcttctagaggcttctacatgtcttggctcacggctctttcctccgccttcagagccagcaatcgctgcctgtgtttttctaatatcatattacttgacaccgactcttctccctccctcttccacatttaagtacccttataattaaaattgagcccacgtggataattcaggataatctcctgttttcaagccaaccaattaggaatactaactccatctgctgcccagttcacgtaacgtagccacaggttctgggaattaggatttagatgtctttgggcggccttgttcattacaatgaagcaatttccatctgctgcagattctagatctagaagttgccacttgacaactgcgtgactttaggtaaatctcctgacacttaaatgcttccctggctcttctcatttgcaagttgaaggcactgtgttaggtaacctctgccatctctttcagagccctccaagtttgaggaatccttttgatcaaaggtgaaggtcatgaagtgtaatttgctttgccgtggttattgcattctcgttgattgattttttggattggatacccatgaagtcttatgcacatttaaagttaattatttcttcattatataattaaatgtagatgagtcccagtgtaaagtgtcagacggataacttattctttccaaaagaagaacagactcactcagcagcagcttttctgctctctctggaaaggaggtattgagtcgtcttagattaactcatggtcttcctgacaggattgggtatggattttaacagattacagtcatcttggatgccttccagaaactgattctaaactgcttttatttttcataggaaacacccaacaacactgcatagaaattagatactcctaaagtggatttgaaccagtaaaattagctgtaaatatcgaagcataactaaggtttagtgtcttctctttgtaggtaatttgtgcagccctaacatttctcccctctggagcttagctgtacaattctaatcactactgtggtctctgctcagtgggccatcgctcatgttttgaaagcactggctttgtccctatgtgagcttgctagttagttgatacatgcaggagtgtggtggcctcaggggaatggaatttctttcttctgtttataggttagtttggggaaaaaaatgtgtgtgtgtgtgtgggtgtgtgtgtgtgtgtgtgtgtgtgtgtgtgtgtttactgagatggagtctcattctgaatcctaggctggagtgcagtggcatgatcatagctcactgcagccttgaccttctgggctcaagcaatcctcccacctcagcctcccaagtagctgggcctacaggcacacaccactatgcctggctaatttttaaatgttttgtagagatggggtctctctatgttgcccaggctgattttgaactcttggtctcaagtgatcctcccacctcaatctcccaaagtcctggaattacaggtgtgagccactgtgcctagccaaaaatattgtgcatatttttaagcactggttggcattaagtttgagggttacagggctaaaacaaaagatgagattttactacaaaaagaacttggaggctcttttagaattggattcaactttcttcctgctatagagactatagattgcttgatttatgatgcgagatttgattcttcatgtcatcttgccaacacagccgctgcagttgtcttgttactccagctctttacccagcatactgtttgccagttgaatgttattcaagccagaagtttggcaaaacactttggtacaataaaaatatatttaagaatttaacattttggctttttattgtagtattgagtagggaatgggaaattagccaatgataggactactagggtctacattcgaaagaacttttatagcacaatcttttggtaacttatttggttgaggacgtactaaatacaaataatcatgtgggaatttggtgagctatggtaatgaatatgacgtgagatgacttcagaggagtttgcagttccgtagtagagacagacacgtgtagaaaatcctgtattggtcttcttccttgttgaccgtagtgctttcagtggggtgcatctcattagaacgttgtgattgggacatacaagtggaaggtttctttaatgtctggttcccatatcggtgagacatagccttaatgtattattctccagaggggcaaaccatccaagactattttagaattaaggacttgctgctctggttacttggtcactgttgagaggatgtgttggaatgacatagcaaaccatgagatgatggttttggaaaaacatcagccgagtaagttatttggtactctgccttaaaaaaaaaaaaaaaaaaaaaaactgagccataaatattcaaaaaagtttgtatgcacagaacacaaaattccaagagaattatttgtttcctaccctaggagtcaaaagtgtttgtttagaataatgtgtaagagtttcttaccccgcccccaggattaccaattcctttaacaatgccctttatttgtgcatcagtgctagtaggtttttcttttaatcagaaataattttggtgagcgtgtctatgcacacagaaatagctactaagatcattaatattttattgttgaaagcagttttatcttataatcacattttcatttgatgtttttagttttctgcttctctcacataaatgcatggtgtcgagagaggcacaagtatttttgtctctaatatcttaaaaattaggattaagtgcattctgtattgttttgtattcacaaaatagttttgaaaaagcttgagattaagtgaaatttgtatgtttttaaccatagtttttgtgggacaaatttacgctttatctctttggtttagatgtggttgacatattgatgcatgtattctctttattctgtaggctttctttttccttagaaatgaagtcacattcagtagttaaataatactttactcaaaagtacagtgatttgaaaataaccttcaactgtcagaagaggctgaacttgactgaaatgtggcctcctaactgaatattgcacatgaatcttaacagaagttatcataaacatttaaatatttgcacttggtatttagacattgattttcaccaataactgaatagatataaagcctatttttcttctttagccctcatgaatatcaattcagtttgttttttgtttcttctgggtgattcatagatgaatgcctagtgtcttcatttgcaagctgttcatggaaggaagccacttttctgttgcctctgtaaccattgcagggccttcaatagcagccttcagacactaggcatgcattcagcattggaataaataggatagccaagggtagctaattattttcaggttaattcctaaagagttaatttgcactgccttgcccaaaatcaaaccagcagaacattttattaagcaaggcttttgtgtgagtggtatggaagcactgaatcagttgctgtttcttttaatctaaattatcgtcattttgagctttatattaatacactggctgagtaactttgtttaaaagaaacctaggtaaattgatagttctatgttctaaattcttctgaataagaaaacagtgatctgccagatgaaaaaggcaattcagaatgtgacataacttctgttgagagatttttgttgaaaattgggaagtatgaattcttcacagactttcataaaatatttcaatactcttatttttaaaaaaccttgaaaagtcagaaatcagttagaataattgacttctaggcatagaaaaattcatttaaattttatttatcctggatgtcttcttttttagcataatacacctaaaacagatattccactaatatagagtgattgaagtattcagaggaagattgcattttaaagctataaagaacatttaagagtaaatgtggaaaacagtatgcagatttcttaaaagaactaaaaggatacctgccattcaatccagcaaccccactatttggtatctacccaaaggaagagaagtcgttatatcaaaaacacacctgcacgcataggcttactgcaaaaaaaattcacaactgcaaagatatggaatcgacctaagtgtccatcaaccaatgagtggataaggaagatgtggtatatatgcaccatggaatactactcagccataaaaataacgaaataatgtcttttgcagcaacttggatggagctggaggccattgtcctaagtgatataactcaggaatggaaaacctaatattgttatgttctcacttacaagtggcagctaagctatgggtatgcaaggcatacagagtggtataatagatttggagactcgcaagtggggagagcggaaggggtatgagggataaaaagacacatattgggtacaacgtacagtgttaagatgatgggtgcactaaacgctcagacttcagcactgtacgcttcatccacgtaaccaaaaaccacttgtacctcaaaagctattaaaataaaataaaacataaaacaaaataaagagaatatatagcctacttccttaggttttatagtcaaagcaccactgatttagaatctaaaggcctggcctcaggtctgattctgctactttacatctgtgtgaccttgggcaagtctcttaacctctctgagcttctgcttcttaatctgttaaaaaaaaaaaaagcataatttgtcttatccttgttttgatcaaatgaatgagttctgggaaatccatccagctggtcagtggaatccacgtgcgagcacagcaaggcctaacgaatttgctgacgctcctctgaccacctagcttcacagatgggtgggcagccagacctacaacccaacccacgtctgccaagtcccagcctttccattcacctttcaagggaagaaaacttctcatgtattggaaagcacagtgcctctagtgcctctctttcttgattgttggagttgggtctctcagcattgtggttcactacgacagagcatcgcttttaacagccacataaaataaccctcttgggtaacacactcaagaggcttcgtgaactcgggaggcaatctgggcaggcttacagctgtgtgacaacacaaacgctgtttatttgagtgttatcaggaagatgtgtcactgtcatggttgaatatggagaaacaggtgcccgcctcggaatggctacccaagtcaaggaggacccaaggctaatgtggagaccacgttcctccctggagtaccggggttaggcagggcttgaatgaggtgcagcgaggccggtgaaacacagcagtaccacgtgtcttatgtcacatcagcaatgcaggtcgcgctcgtcacagacatttcagatggagctgggtattatattccagtcctggcatttattatggtcaccaccagcacagagcgttcctggcctggtgctgtctggtttctggaatacaggccatccttcctgatattctaaagcctgcctcccaccctcaaagagtcagacggcaagtttccatccaccctcccagttctcagcctttgaaggtgagaagctcctcttctaggggccgctgtcagaatctcagggtttggcactgttgcgctcgcctccattccccaggctcctcgacggccttagatgcttaaacacgctgctgcctctcatctctggaccaaggctttcgtttccctgtgagtagacagcactaaggcacggggttagtttaatgatgcaagtcaactggggagccttgctgctatagagataccctttgtatgtttactttaacttcttgcatcagtcaattcaggctgttgtagcagaataccacagactgcacagcttaagcagcagcaatgtattccttatgattctggaggctggggaatctgaagtcagtgtgctggcgtggtcaggtctggtttgtagatggctattttcttgtatcctcacatggcagagagcacagagcaggctcttgagtctccttagaagggcactaagcccattcaccctcatgacctaattacctcctgaaggcccccctcctagtgctgtcacattggggagttaggatttcattgtatgaatctggggagacacaaacattcagcccatagcacttccccagccgtgcaacacaggtgccctttggtggtgtttgcataggtcatggctgctgatagccaccgtgtgttgactgcccactctgtgcttgacgctctgctagaggctctttatgttgtctttaatcctcacttcagtgctgcaagggctgtgttattcccagctgacatatgagcttccaggagtttaatggatggaagctcagctggcacatggtggaggcaaacccagggatgtctgactcattcgaatgtttctttcgttaagttaagtcttccattcaggaaaccaatattgcaagttcaacgtgtgaaaatgtcactaggctccacggtgctagagaggtggatcctgatgatgtcctgtgctcacggcgcttactttgattggcacccagagagaagacatgagcaacactggttgtgttcagatgagagacagtgcacctcaagggaagtgttggtgaagtcctcagaggaaggaggaacgcaaaggcctgtgttcagaacaccgtggtgccctgagaacagctgccaaggatgctcgctgggagccacaggccaccagggggaagcgccaaggccgtctttcaagatgcagttacatcatcactgagcagcaccagctcagggctgctccagcaagcctagacccaccctgcttccctgcgccactccccagggcctgctccacaccacccacaaaaggcaggcggacagtggaagaacactccaggcccccagctccaaaggctcagatagccgctgtcgtcaaaacctcatgtcaggctctgtttttctttcctttcttttcttttcttttcttttcttttcttttcttttcttttcttttcttttcttttcttttctttcttttattatttctttctttctttctttttttttttttttttgagatggaatcttgctcttgttgcccaggctggagtacagtggcatgatctcagttcaccacaacctctacctcccaagctcaagcaattttcctgcctcagcttcccgagtagctgggatgacaggtgcatgccaccacgcctggctaatttttgtatttttagtagagacagggtttctccatgttggtcaggctggtctcaaactcctgacctcgtgatccgcccacctcagcctcccaaagtgctgggattacaggcgagagccaccgcacccagcctttccttctccctttcttacccgacttccttggaattggtattcaggaccttccttttctcctggtatctgcccagtgatccaggacagcgctcagctcctggtagccctgggctctgtggtttcaggctgggtgcatctgttcctgtgccctgatctcagcctggcccagctccttggcctctccaccctccacttcccttggaagaaaaaatgggggtaacggtaaggaggtgctctgagtaaagcagtttccgggtccaaaataattcaaagaaatgaagagcaaaaatcacagtacaagtagtttagcttttcctcagttaatctgccataatattaagtaaagctagttttaagtatttaggctctaatgaattccatgtactaagttgcctggctgttttctaatacatgttatttgaagattctcttgaaaattgcttatatcatgctgctatgttacaagaacatggttttcacgcattctggtatggaatgtgtatgttgctgtcacttatttaataataatagtcacaattaatcagtacaaatatttatggccctaagtaccctgagatctgttgcttgatacatgtctgaacattttggacaaaaagaggccagtgtgggacaatgagatagccttttaatagagagattcttttctcttaacaatgatctaggggttttcggggggaaacacacacccccttctccatcgggaccgaaactgctcttgtccgtgtgttctgtcacacgtagatgaacaggctttcaacacctgcactggattttataatgcattgggtttggttattgtcattattgtttttaccagtttatttattcattatggtgctagccacaaagcttatgcatgctgagcgtgggtttcaaattttgagtttttttgaaacattcaagacacggaagtgggcatcacaggtcatgagttctgttcgataatgatgtcactggtcacccatgttgcttttgacttggtaaaagaaaaattgtacttaggaaaagctgccctcatataatgtgtactcatatggtagttaaataagtccagtcaagggctgtaagacagccaatcagaatcttgtttctaaatgggcatgtttctaaactggtctatgatgtgctaatggacagaattttgcatttggaaaattgccatcacaaactcttgagccttccattcttaaaccagttgcaaggggctttaccaaactgacttatccaggttacagatataacaagttcctgtaggtaatggctctcatactagactgcaagtttttttttttttttttttttttttttgagacagagtctcactctgttgcccaggctggagtgcagtggcacaatctcagcccactgcaacctctgcctcccaggttcaagcaattctcctgtctcagcctcccaagtagctgagacagggactacaggtgcatgccaccgtgcctgactaatttttgcattttttttgtttttgtttttttagtagagatggggtttcaacctattggccaggctggtcttgaactcctgacctcaggtgatccggccgcctcagcctcccgaagtgctgtgattacaggcatgagccccctcgcccggcctcatacttcattgtttataagcgtgtactgggcacattgtgaaacacaaacgttctcccaccctgtccccagagactccagttcagagggtccaggaatctgcatttgacgtgcacacccgggggttctaaggctatttttgtaccatcattttgagaaatacatgaagctatttcaaacactcctcataatgtcaattagtcttctccttctgtcctaggaactagataattattatttcttttgtccaaaatcctttggattatacaaatgcattatatctggaggcagtaattaagctctggcctggcccacttttctccagataagtacactgattaccttcgcgtttccttacaggtccaactttccaacaaaatcatcactgtttgctttcctttaggcctacacgttcttttcctctgttacacaatgtctgaagtaaaacaaagatttctgtctttcctttcatgttgtacatgttgtgactaaaacacatgcctcaggtctcagtctatcttaaactgtggttatttctttaaaatccattttacctataagaacaataaaggcgtcttcaggctttttaaacctgtaacaatttaaagacattgggtcataaaataatgtttaacctggactgatacaattaaaataaaacattaacagtctgaattttgtttaagatagaaacttagccctcttgttcctggtatgtgcgacttcatgaaaacccaagtttcgctacttaaagtgcagactatgtttctatagtttcaggtagaaattatttggaaatgtaccatgctgctgtaaaacaaacaaaaagccaccctaagcccgtattttctccttttgtgacactgcagagttatagtttccacacagatatcgtgcctgcagggcctttagaagcatgtggctgctggctttcaccctgaaggtccagactgctggactcttcagccgccgcttcacccttccctctctgcttgctgctggctttggggttgggatctgcttcccactctcctgcatctgacgtgctcttccatttttctcccagtccatcatggtaaattcttgtcttcatattccttctcttctcccacctttgtttctgagctgctcacctgagctgtgggagtgcaactgggatcatcagcattttccaatcaaagtgctcttatcttctgatcagcaaaataacccatcacagaaatgactgaattaatgactctctagacagttgagtctcttccacgtttttgatcagggcctgctcatactcagacatttcttgtttgttgttgttgcttttatgttcatggctgttcccaagcagagagaatttattttattctatttttatttttattttttgagatggagtctcgctctggtcacccaggctaaagtgcagtggtgcaatctcggctcactgcaacctctgcctcccaggttctcaagcaattctcctgcctcagcctcccaagtagctgggattacaggcacacgcccttatgccccattactttttgtatttttagtagagatagtgtttcaccatgttggccaggctggtgttgaactcctgacctcaggtgatccacctgtctcagcctcccaaagtgctggaattacaggcatgagccaccattcctggctgagaatttcatttaaattgtggattactaggcattaattatgtttgtgtgagagagagtggcagagggacattgaaagagcaacagggacagagagacagagagagaacaaggagaaggaggacgagagagaaagaaagagggaggaatgggagggggtactgagagatcacaccaaattcattgcacgttcctgtgagttgctgccacacgctgcactgggccaacgctttcccaccagtttcactagtggagatgacctcatcggatcctctttgccatcttctgtgaggttggaaccatgcagagtcctgcattttcctccatctacccctaagtccttgtgttaattatgatctgtgttggcttttatcacctttgtggaaagagaagagccaccaataatgaagactgagtaaatgagccagtgaaacagagacggggatgtgcaccccccaggctcctggatgattattgacggacacgtgtcagctgctaaatgttatttaaaacttgttcttgccatcctatcatcatttgctgtcctcctgaatatggaaatacaatgattagaaggctgttttaccatcctgagatatgtgcaccattgattttgtaatttgttgctaccttctacttatagtaaatggtccatgatacataaaagaaatttatgtcagagcttttcacagtgaataaatattaggaagaaaatacatttagacaatagaaggaagcagtgtaatgggagatcctgcagtcatgtatgtgtcgtttattttctcccaatattttttatagtagctgtgtgaatatcttactttttacggtgctcaattccacattggcctgatatttgacatattttaaggcacagtgggagaaggaaccaatcctgacctttctctaggcacttttctgatgtcagtagatgaactgaataattaatatctgacttcttctggaacttatttgaggtggcttacagaatcctcccctggcttcctattgtgttttggataaaaggcaagaccagtggcacggtccacgaggctgggcctggttttctttgtgcctgtctgtccagcttcatctcggatgcttcacgcctcactcctgacatgtagccacacatgcaccaggttacaaccgctccattgcatgggaaacctgccccagctggtcaccacctccttcctgtatactcttcaactctcagctcaaattctcttcctcagagcacccttgcttgccccaacacctcagtaaaaatcagcacatgccccatcattatacgccctcttgacacatggaattcctgcccactgccccacctcacagtgtcactgggtttgcctgaggtctctcccaccgcgtgcaagtgtagggatgtctcttcagttcagcacgttaggccaatgctcactgtcacaacattggtatccagtacacgtggttaaccattgctattgtgaaatattataatgcaaaaactatggaacatgtaaactcacagcttaatgggtgagtgtaacctgaatttcctaatgtgaaatagcccattcaggtctagaaacagaggacagccagtaccccgcagctcctgtaccttgacttcctctttccagtggcaacttctctctccccgttgagttatgcagcatcctggatttcatggaaatgtctttctggcttgtcttcatgaacttacgtgtgaaccactcacttagtgtagtttgcccactgtggaactttttacaaaaagaaatattcatcttatattctttactgtctgatctatgtcacttaaaattatatttgtgaggttcattcatgctgtgcatgtagtcagaggttgtgatttgcatggctatatggcattctgttacatggaatacaccactctggtagacagaccaatgacaccccatgaagatgtccgtatcccattccctggtacctgtgactatgttagcttccctgacaaaggagactaaggttacaggtgaataaagatagtaagattactcatcaattgcctctctgcagccaatcatttctctgatgctatttgtttttccattatactggattatgtgaaaattctgatactaggctaatagctgtttaacatggatctaatgaatagattccattctaggccagctatagtttaaaaatactacagctttctttttgagtaatttgatacctaaaatagtgaagacctcaggaagagcccatcctctttgagacccgtgaacattctgccgtgccaactgtcttggctggcatttgcttccccttaaattagcttcctcctgtcacagaggggcccatactacaaggctggtggatgatgacaaatttgattcttgaaaatctgttaaggtaattgcaaaattccactcagtttccctgggaaaataactctacctgctagtagaatcaccagccttttcaaagaaaatgtatacatcaaattagcaaattagttattttaaaattgtaaaccaaaggccaggtgtggtggttcatgcctgtaattccagcactttgagaggctgaggtgggcggatcccttgagtccaggagttcaagatcagcctggccaacatggcgaaacccagtctctgctaaaaatacaaaaattagctggacacggtggtggacgcctgtaatccgtgttacttgggaggctgaggcagggagaaatgtttgaacccaggaggcagagattgtagtgagccaagatcacgccactgcactccagcctggatgacagtgagactccatctgaaaaaataacataaaaataaaataaaactaaattaaattgtaaaccaagagtgttgttggaatttccacctagtcttcgagtgtaagtgtagctagaatatgccgcagacacaggagcatacccctcaggaaccagggagcaggcgctggatgaagcatcaatgcttgctgtacattcggcttttgtttttgagtttcagaaacccactcaaattagtttaagtaaaatggaaaatgaaatatctcctaaaggctgggcactgtggcaaatgcctgtaatcccagaactttgggaggccaaggagggtggatcacaaggtcaggagatcgagaccatcctggctgacacggtgaaaccccgtctcgactaaaaaaatacaaaaaaattagccgggcgtggtggcgggagcctgtagtcccagctactcaggaggctgagtcaggagaacggcgtgaacccaggaggcggagcttgcagtgagtcgagatagcaccactgcactccagcctgggtgacagagtgagactccaactcaaaaaaaaaaaaaaaaaaaaaaaaaaaagaaaagaaaaaaagaaatatctcctaaagtaacaggagtgcattattaaatccaagggaaaaatgcatccaggcctcaggaggaaaagtacatcaaaaatggaaagccaagaggagctcattctgtctctttgagcttcttacctttttgcctttgtctctttgcttttcattctctttggttctgaacctctctacttcattcctctcattctgtaaatctgctttatttcctttggaatctttacaccatatggcagcaggcacttaacttccctccccaccttccgttctcatggtttgtgacagcagccaagaacgacttggaatattttaatctcacaccacaaatcctggagcagacttttgacctaggttaggccaattaattgtctctggctgaggaggagaggagggggctcacagactagaaatgtggcttccagggcccatgggtggaggaggagggcagctccgatcattctgactgggatgctcttcacaatgcctctgtaccgtgctggaacattgtaccagggtggcaagccctttttaaaaagtgagctccaattactttagtctctgccattcaattgctggtggttcttgcctttgaggctagtttgttagttacttaatatttattgagtgcctgcagggatttttgacattgagaagtgatgtgttgagcgtgccaaaaatctacccagtatagaaaactcatctcaaaatcgcctgtgggtttcagagagtctatgcaaaaacagccattatctaaacatgctttaagacgctgttatcatacacagcaaggtgaaagatacaaatgctcaattttaaattctgcagcttacttcatagccatcttttcactgaaagggatttctcttgggcctgatgtgttgtgacatttttttctgtggatgatcaggtcacagtgctgctgcttttggaaatatatagaacaacttgatacctttaaaacattatatcaaaatagaaccaaagtagactgagcccagaaagcaagactaacttacattttgaactaatttcataaaagaatctatcagacccagtcaattaaactgaagagcctaaaataatttgaacctgatgttggaatttgcaggtaaaaataatcaagaagaaatgttaacagatagctattgcatcaataatttgcctgtttgttttctagaaggattgatagggcagaagttaattctgaaaacacagttttgctgaccttcaagtagagggctgacagctgctttagcaagggtggtgggtaggatttcaaactgctgtgccctcaggcagcaacatcaagtcatgttatgtaaaataggcaacttcagaagttcccaaatgtatttgagaaaagtagggtggatcccaggtgagtccatgaggcgcatacggaaagggtgtgggagagccctgggagagcctgagcagtgagacgtcccttctccacatggaggacgtggtggacactgcccaggggaagaggggcacccgcaggtttgtgtctggatgtaccggaaacattggctcctctgcttccactaagatgatgatgatgatgtataattaattgccagtcctcgaaagttgggcaggttaaccaaaattaacttctaattaatgaaataaacggaggtgttggggaaggtgggatgacatcgtcttccaccaccaccacatcccattcccgcattggttgcttcagtctttctgaaagggctgctcagctgcccacgcctgcagtctctgcagttattcacatggaggcggcattaattcataccttgcggccatatccattatccctccctcacccccactactagcaaaagcaccccggaagtactcacaagaaacaaagtgacagtcacaaggaaaggagcatctcggggagtgggaaagcttcccctgctaagtacatgcaatgctttattggacgatgagttagggtcctcttgctccaacaagactggcttgcgtttccacctccagccagcattgtgaatcccaagtagctgctgatttatatgtatcctctggaattatttaaagctatcaattacctaaccatgggtatagttatatcgtagaaaaggccactttccattttgggagcgagacattgtcttctagtcttaatatacttctgcaggctgcctgatagaagaagagattgattggtttaaagatagattgttatgagagaaataatttacttcacttcctccttccctagtgagaaggccatctggttgacccctctgcctttagctaagggacatagaatgcacaattgccagctgtccccaatgtggctggcaaggctggacctcagctgtccccggggtccctgctgtgctgcccccgattgctccagtcttctcctgcaggggtgtgtctttaggaggaggctttggttgatcgtgaaatcatcctccaatctcacttctgctggaggtgactccttctgtccctttagctgcgtaaggccagacttacattacatgaaacaaacacgtcatgggatgtgtacccggaacattcacagtggttattggctgcttgaggtatgcatcactttactgtggagtcacaattatggatccaataacctggatcactctgctttgaggacccaaaacaaattaaatttctgatttcccctcattaaagctcaggatgcaacaagaagttggaggatcacaagtggaatgtgaccactctagccccttccctttctttataaagagtaggaaatgcaatgcactttcgagttctttctctattacatatcatatgttgctaaaacattacttggtggtgatagcaataaatagtaaattagtatcttgtgtttctataatttttataaattatagtgtgctttcaaatacatttacatttaatcctgataacacctatgcaatcagttccttttgtgtcccactcctttcctccttgcagcgttcaaaaatcgtctccaacttagagttctcatttgaatcttctcctcttcataaggcacaaagtctgataaaggtagcaagcaaggcaaatccatgagagatacgaagctcaggccaagatgagacgtgtcagattttaacagagaggagagaacagggatgcataacctgacagagaggcgtgggctctatcagctgtagctggggagaaaattaaagcggcctgcattagggtcctccttgaatcagttcatagacattgtggtgtctacaattattatcttaatctgggtttcttgcactcgagatacaaaattggcacacacaaaagtcaagctgtaatcacaagttactaagataataacattggataaaggtgaattttatgtttaaaatgaccaaacgactcagaaaaggtatagcttggttttagttcgttgtttgttttatttttgcctgagttaaaaataagtatgagcagcagtgatgtcgcaaaggacaggattgccaactatgcgtgtcagtttgcattacatcttgcagaatccattgctgcttatggcctcattcacgcaactgggcttgcattaaccctttgctttctgcatccatcaatgattgcctttctgttacttctaaaggcatttatccatccattcatccactcaacacagtctctgtgcactatgttgtcccaagttttgtacgagacattgagacgttgaacacagtaaggtaactgtgtccttaagtagtttgcccccctggtaatgacacatgcattatgataatatattaatactcatactaagataatatatattaaagagataaattaatagtggaacagtgttacagaaaggcactcacagagtgttgtgattgtgtccagggggaaagaataatgccggtgaaaccaggcaagacttcctacgatgtcagaggtgatattttagctgataagtaaagaatgcaaagggatttgcctggcaaaatgaagatgaagggaaattccaggaaacagaaaagttgtagggcgtgttgaggaaaggggacatggaagggaatgacttgctccaggaacaatagggtatgagcggagtagggtagaacttagatttggcctagaggtagaaagaggacagacttgccatgtcacaggggcaaagggtgtttttttcttgaaaacagaaggctagagccccagagagggctttacatgcaaaagggatacataaatatatcccgacacctaggtctgtatgaccttctcagaataacactgttggctaatatctttctattgtatgcccagaattcagctacttcccagcatacccaccactgccacccaggacagacctccattacccctgtgccttgttggccgctcctgttcccaccctggtttctgcaagtgtttcctctaagcagctcccctggccaccttccttagtgggagccttatttacacactgctgtgctcacacccctttcactcagaggtaagccgaagcctgcacctggccctcaggctctgcactccctggccccttactgcccccactcctcagaacagtcaccttgctctcccactctggccactgcctccttgctgtctccactgaagcctatgctgtctcacaggccaggcacctgccactccctctgtctggattgtcttctcggatgtcagctctgcagattccttcagttctattcagatgtcactttgctagagatctctctgatgcaaacagctcccagagctccattgtcctgcttttctcttctcttagtgagctgatctgcttattgtttgtcccttcccccattcctgcactagattacaagaaaaaaaatgaaaaaaaaaatgaaagccattcaacttctgttgataacagtgtcagtatctgttttattcattcttgtattcaaggttctcaaaacctaacctggcatagtaagccctagataaacatgtgttggatggatggatgtggattgacagatacatggatggatggatggatggatggatggatggatgagtgaatggatggacggatgtggatgaatagatggatggatggatgagtggatggatgggtgaatggatggatggatatgtcgatgaatgtggatggatggatggatgtggatgaatagatggatggatggatgagtggatggatgggtgaatggatggatggatacgtcgacgaatgtggatggatggatggatgtggatcactgggtagaaaacttattcttcttagagcaaatggttaattgtgaacatgcttttccattttaatggatctccaaagtatgcatgtggtaacggaatagggaatatgttatagcctcactttcaccatgctaggcaaaaaatgtctcattctactgagaaatgcactactgacactcagtgtgccgggggacaacctagtgacttctcttgactttcatggaaagcagaatcaatcctactcgaattttcaacagttcaactcctgcaagttaggaggaagtctgaatgtggggagccaaattagatgttcaaagaagcacatattagcttgcattctaacttgaaaactgcatctatgctgtggttgtacccatttaaaaattaaatgtgcatatagaccagaaatagaaaacaatatgaaaaaggcttggccaggcgcggtggctcacgcctgtaatcccagcactttgggaggccgaggcgggcggatcgcaaggtcaggagattaagaccattctggctaacatggtgaaaccctgtctctactaaatagacaaaaaaaaaaaaaattagccaggtgtgattgtgggcgcctgtggtcccagctactctggaggctgaggcaggagaatggcgtgaacctgggaggcagagcttgcagtgagccgagatcgcaccactgtactccagcctgggctggaaaaaaataaaaataattaaaaatgaaatagaaacaatactcaaaagatatcaattatttgagctaatgaagataacattaattttatcattctggttcatgaataagatttggtcttgatgttctgtttttaatggtttccttggaatttcatcttaacagcgtttgaggaatgtcaactgggctgtgagaaattgcgtgcactaggttgcttgtatgaatagtaccactgaaagattcctgctagtcacagacttgatgaaaagggcttattttctttctgaattcaggtgaaatgaaaagctgctgaattagcaagatctaattacttatccttggccctggccagtgattttctcccaaagaaaatactacctaataggaaatgagattgaatcagtgtaactttctgtagctgttttgttgctcacggatagtcttactttttaagttctaaaaagctactctctgtagatgaattaagttatagatggcaaatatgaagacttgtagaaattctaaaccactgtagaactctttcctactaagcctataatggccccatgaatttttcttaatttaataacaaatatagccaatattaaatattttggatgatattgcatattgtctattttagtttgtagcaatttgacacattctaaagaacttttaatctttgatgaaaatatatttatgtattgcattgtctactttttaaggccgtcttcattctacctcattttggcttggttactaagttgcagttatgtgcactataagagtgtattctccagactatacatggacagaagtggtccctttgcagtgtgaccatctgtccttatttgttcctgtataattaataataatccatgtgtaactattatatttattacttattatcaagcattcatatgatcctttttgtctctcaaagaatcacagtttcgactaaaagttatatgattcctctaatttgcacggaactgaaaacttggtctcagcagccagtacgcgtgatgaatttcctagacttatgtagtctttagcaccctttagcagtgtctccagagtccctctctcacctgccactcttgctgcagtgcaagagggttctctggaagggactgaaacctagaataaggataggtgagttgcccagtgaagagagaccaggaaaatcttgaaaccttgaatgaggagctatggaaaaaagaaaagcctgaaggcagtgcgatgggcagaagttggtgaaaattggcacatagcatgtgctaaataaatatttaaatttggtaccctgaaatagaagttgatcacatggatgtaaaaaaaaaaaaagggaatgatgacagaggacttggagctgaaaagtttaatcctagttgggttggattcaatgagggtaaggaatttagctgtgaagaaggaaagctccaagatgaccctatactgcagagtctggtttattgggaggaggagcattaggtttgcacaaaagctgcaaacataataatatcagattctttcttgaggtaacatttggccatagtacaggaaaatgacagccgaaggctttgggccactgaaggcagaagggtgcagaagggtacaaaagggaactaatagtagcttcaagaatgggaagatgcctctttcactgttttgtatcttggttcttgatttaaatgaaatatgtctatttggcttattttatttccttatttcactcactggggttttctttgttgttgctgtttttaggagctggtggggagtaaccctccgcagaggaattggaaaggaatagcaattgcactgcttgtcattctggtcatctgctccttgatcgtcacctcggtcatacttctgacaccaggtactgtattcattcttggaaaagcaagtcgctgtcagagagaaagagcataattttaccttgcaatttttttctaagtaactacctattacataatttatttttcccaagttctaattctcactatgccatatgatataatatggtttcaattttaaaaattcattttatatgttttggatttgttcacaaagttgtttactacgtggaaatgcttggcatatattaaaattacttatacaatcacttattcatgcttgatcaacttaaagacagtggcataaatataatgattttatatatttcatagaattcctggacattatatcaagggtgaattaagaaaattattaaaacaacatatgttgagtgtgaactaaggagaaggtgctaaataggtactactgaatattacataaagtataaaccagtgtcataaatctctcaggaaagaaaagacactaaaatccacagaagaaacctacaacaaatacagatatatacatgcactattgagtaagccaaagagaagtgctattggagttgagaggagaaagagaaatctttcaaaagaaagttcatggagaaggtagtacgtaaagtgggcttaatggagtaatggtaggaatttagtagccagagagtggtaggattagggagagaagaaagcctttgcctataaaataataatatagagctggacatggtggcttatgcctgtaatcccagtactttgggggactgaggcgggtagatcgcctgacatcaggagttcgagaccatcctggccaacagggtgaaacctcgtctctactaaaaatacaaaaattagccaggcgtggtggcaagtgcctgtaatcccagctactcaggaggctgagacaggagaatcgcttgaacctgggaggcagaggttgcagtgagccatgattgcgccattgcactccagcctgggcaacagagcaagactccaactaaaaaataataatgataatataggagttatcatagaaaaacattgtggccatagataaaacagtatgtaactgttttatccgttctcatgatcatagtagatgcctatttgtgcaggcaaaaaagttttaattctcagtaaatacatacacaagcattagaccttaagatgaaaaaaagtagatattataatataaaacctttttccacaggtacaacaaatgtgggcaaattataatccaggcttaaactattaccccaaaatctaaatgagaaaaggacgatctgtaccctgataccaaactagataaagatatcacaaggaaacaacatgccaataccccttatgaaaatagatataaaactcttcaacaaaatagtagcaaactgaatctaactacatgtagaaagattatacaccatgaccaaataggatatattccaggaaaaacaaattggcttgtatgaaaatcaatcaatgtattatacctacattaatagaataaagggcaaaaagcacatgatcatctgaacagacacagaataagcatgtgacaaaatccaaaaaccatttcctgacaaaagactcaacaagctaggaacaggaagaaacatcttcaacttgacaagtatctgtgaaaaacccaatagctagcatcatactgaagagcagaagactgaaatcagtccgcctaagaccaggagatggtagacaaggatgttcattcccagcatggctatttaacattatattggagggtctagccagggctattaggtaggaaaaacaaaaacaaaaacaaggacaaccagataggaaagaaagaagtaaacctgtctctattcatagaagacataatgttgtatatagaaaatcttaaggaatccacaaaaaaacctattataataataaatgagttcagcaggaaggaagatttcagaccaaaatgcaaaaatcatttgcatttttagccactagctatgaacaatcccaaaataaaattaagaaaatgattccacttaaaatagtttcaaacggaataagatacttaagaataaatttaacaaaataaagaagtataagacttgtgtactaaaactacaaaacaaaatggaaagaaattaagacctaagtaaatggaagtatatcttatatgaattgattgaaagacttcatatcattaacatgacaatactccctaaactgatgtgcagattcaaccaaatctctatcaaaatccctctttctttcttaaagaaactacaagttgattctgaaattcatatgaaaatgcaaaggactcataatagtcaaaacaatctcaaaaaacaattcaaagacttatacctcctgattttaaaacttactgtaaagctacagaaatcaaaacaatatggtactaggataggtatagacatatggatcaatggaatagaattgagagttcaaaaataaacccatacatctatagtcaattattttttgacaagggagtcaagaccattcaatgaggaaagaatagtctttccaccaaatggtggtggtacaactagatattcacctgcaaaagagtgcagttggacccccaactcgtaccatatacaaagatgaactcaatgtggaccaaagacccaaaatataagagctaaagctataaaacttttagaagaaaacatagggataaatctttgtgactttgaattaggcaatggtttcttacatgtgacaacaaaagtgcaagcaatcaaataaaaaatagataaattggacttcatcaaacttaaaacattttgtgtatcaaaaacactatcaagaaagtgaaaagacaacccaccgaatgggagaaaatatttgcaaatcaggtatctagtaaaggtctagtatctagaatatatcaacaactcttgcttctcaaaacaaacaaacaaaaaaacaaataattcaatttaaaaataggcaaaggatttaaagagacatttctccaaagaaagacaaatggccaaaaagcatatgaaaagatgctcaacatcattcagcctcagggtgaatgaaaatcaaatcacaatgaaataccacttcacatccactaggatgattataagaaccaaacacaaacaaaaaatggaaaatagtaagtattcccaggatatagagaaatgggaaccttcttacattactagtagaaagataaattgtgtggcctctgtggaaaatagttcagtagttctcctaaaagttaaacacagagttaccatattacctagtaattctactcctaggtatagactcacgaaaactggaaacatatgttcatatagaaactagtacatgaggttcataacagcattaatgataatagccaaaaaagtgaaaacaacccaaatatctatttcccagagaatggataaataaatgtgatgtggcggggcgcggtggctcacacccataatcccagcactttgggaggccaaggagggtggatcatgaggtcaggaagccgagaccatactggctaacacattgaaaccccatctctactaaaaataaaaaaaaactagccaggagtggtaacacatgcctgtagtcccagctacttgggaggctgaggcaggagaatcacttgaacgtgggatggtggaggttgcagtgagttgagatcgtgccattgcattccagcctgggtgacagagctagactccatctctaaataaataaataaataaataaataaataaataaataaataaataaatgtgatgtaaccatacaatggaatactcctccactgtaaaaaggaatgaagagctgatccatgctgtaacatgaattaaccctggaaacttcacactaagtgaaggaaggctggcataaaaggccacatattgtatgatttcagaataggcagatccctagagataggaaatagatttgtggctgctgtaaggtagaggtagggagaaaatgaaatgattgctaataggtatgaaatttctttgaagggggatgaagaaattattctggaatttgatagtggtgatacatgtatgactctgttaatattatatattttaaaaacactgaattgtatacattaaaaagatgaactttatgatatgtgaatttcatctctattaagctatgagtttgataaaaagatgggaaagctgttgggggagaaaagtgtaacctggccacaaaagtgccagacatactaaattgccttaaaaacttgtgtaactccaaagaggcttcaggagcagttccgggagagagagcgttgcagtctcctgcgtgagcgagcttcgtgaatggagcacagttgcctggaacaatcaggctgaggattcaatccagtgcttcaatgcccaggaaacagatccctgcacctgctgaaatcagatgaccagggtttagaggggctgggggaggaactgcaaagccaatccttgttttgttttatggtggtggtgctgatgatctcacacagctggggactttaaccactacatatttctaacgaatatagaggaagtcaagttttcctcagggtctgtggagcatgtgtttctgcctctacttttctttgagcagaattgtgctttgtgtaagaacatgattactgcagattcgatcttgtggttgtctggcactccctttgggacttgaaagcagtggtgtctaggggtttgcagttactcccaccttccaaggtgcatgtgaactttcatgtcaccccggtccaagggctgtcacgagtgtcactcaagagtggaataaggccggtgtggtggctcatgcctgtaatcccagcactttaggagggcgaggtgggcagatcacgaggtcaggagatcgagaccagcctggccaacacagtgaaaccccatctctactaaaaatacaaaaattagctgggcttggtggcaggtgcctgtaatctcagctactcaggaggctgagcaggagaatggcttgaacccaggaggcagaggttgcagtgagccgagatcgcgccactgcactccagcctggcaacagagcaagagcctgtctcaccaaaaaaaaaaaaaaaaaaagtggaattaaatggctgcccggagcttcttacaccgaaatgtccacagcagcaaagcgggttgagaaccaggtcctgggaccctgtcctccaagctcaactccaggcctggcaagcagtagccctgcgtcttctccacgcacagggagtggcggcaggcctcctccctccagcacagcagctgaccctgccagcatctacattcagttcttttgcagccaaggcaaccacagcagcctcccctctgcagtaaacagaggatgcagttgctgggaactcttctccctccatgctgacggccagttgtcaggggcaactgctcctggagaagctctagtgaatggctgaattccagagaaggctttggaggggaatttgcttttcttgttccatcacaatacacatgcagctgagccttgcttcaccttttggttctgctgggctttcatgggtgctgtttgtttctctgggctgtgctgccctgggatggggtgtccaaggtttaggcctctcccacagggctgcacagcaaatgttgcaccgctgctcccgcaccgaggcctgactgcatccactctcctgcaatacagcaatggcttgtgttttggcataaaattccatcaggcagaggaggtatcaaatcattcaacctgccactagctccagagcagtgtcaaattcactaatgtacagagcagtgtcacctcgacagagaatgcctgccaacagagccagcatgaatgatcccggctaggagctgagaactccatgctaagtgccagacagaatgtggaaagagaagatgccagtacttcccatgaagcttagagtccacgtaaagacaatgcatgtgcaaggagaattccacagtagtgttatcattaagtaaaaataaaagtcaaaggcagggtgtggtggaggcctgttgagttgtgtagatagtggaaatgctgacctagagggctgagatcctcgccaaggcaggagtggcttccaccggtgaaagtgaaagatgacagtcagtcttcaacagtggagaatccaagtcgtaaccgtcacacttcgcatatgtttgcacacagtgttgagtgcgttcctacccaacattgcttccattttggtagatttagttagaaattgtaatatgtgcttttttaaaaaaatagtatttttcaagtactaccagtcttgtattctggtttattgcaactcagagtacagtatctgctttctacttaattagaaaatccattctgaactcacttgattcagtcgttttgtgaaagtggttcctggtacccaggggccccttgccacccctgtgagaagaatctcatgcgcatggtggagtgccctcctgatgacgcagacctggaagggcctcatggtaatcactctgaacaacaaggcatcttgtcctggagtacagtctaattatcaccagttatgcacaattgatgttttagaaatcaaattaaaagtgttcaaggtgatcttagttccaaagggatttaccaagtgagaatatgtccctttcaatgttgtcattcatatctcccttgctggtccatgctcttttctaaatttcttctctttggaataataggctcaacgttacattttttattttcaatattaaatatgtatctgtctacaataggccatgcacagcgtatgccttttgttagcagctacagttcccgcattctgatggaaacaccgtgaccttctccggtgccacaatcgctgacgtgggggtcggaaactccagcaggatcggatttgcatgaaaacatccctgacaattggcttttatggaatctcacattagagcaggtggacagtggtttatgccggaaacactagaacacttttaggtggtacatcaatgagaagccttgaataattcaaagtcatagtgaatggaggttctgggttaaggccaagcacaggttatcagaacacaagactcgtcagtcttttgggtagaaacgtaacatagagattacttttacggaattaaaatgtcatcactgtttaatgtctgtgaccgcattgccaaccctcaccttatctttttaaaattcttgaacaaataatttcaaaacattttattgaagaaggatatacatataggatatatattatatatttaacataaatattatatagatattaaatatataaatataaacacatgtgagtaagctattgttgaattttgatgaattttaaaaccaaacttgattctgtaatcagcatccaggccaaaaaagcagaatgcagccagcatccggaaagccccccaggcccttcctatcattaatcctctcaagggcaacctcatttctgacatcacagagtagtattatgagtttttatattctttgcatttatggcataaatgtaatcatctggtatgtctacttttatgcctgcttttgttctatatgtttgtgagattcatagttgtattttagattgtactgctacccaatttttaacctatattggattatcttatcataaagtcccacataatctcaatgaaaattgcaaaatagcttaacagtcatttaatagcttttgtgtgtatcataaaaagtaatgcatacctcctaatttttttttgtcttgtagaaatagatggcttgctccgtatcttttgggcattttctctctgttagggctcctatattaaattcattccacaaattcaatcttgttatattccatctactaacactgaccatggcccaacccatttcatcatgggaagcacaggtggcttgagtgggttctggtattgttcatttgccctggggcatctgctctgtgagtcctgggctcctccgtgcctgctcacacccatctgcagcggactgactggattggggatggtgtctactctgatcatgaaacacagagttgttttggctgctgccgatgctaccactgttaatgtttctgcccaaagttaacttgttaatactaatcgagactgggtgctataaatagaggctgcagatgatattcattatgatggtccaaaacatgggagaggccattgagaacaggatacattcctggaaggcttcgtggagaatgagcaattagggactttaaaagatagatccagtagagatggaagaaaactgagagggaaagccatgagccctcgggggacagaggacagtctggccaggaagttgtggaggggccaggtgtggtcaagagttaagggagaaggaaagggatggtagccaatggggagagcctggagcgcacagggcctggatttgagactgaactctaacttctcataccgtttacaccagtgtcctaaccagtttcagaatctgatgaaaactgtaagtcatcttatcgttggaaggaaagaaagggcattgtgtgcacataaacatttggatatgttgtattaatataacgtttgcaaacctagtcagtccatcccagggccatctcagggatctgcttgagcgtttatccaaggtccaggtgttaaagtttgtcagccaaaatatttttgtctgtgagtaacagaacagccaactaaaactgttccaattgcaggtgtccgtattgtttcacaagacaagtttagacatagccagtccaaggcagattcagtgctcgtggatattgtcaaagtccaggtgggctccatctctctgctgccatcagtatgtcgacaacatggttgtgacggcttcatgcttcactcgcccacacgcacaggaagggatggacacatagaacttagcttgtgcatctcacttcctctgtcatggaggaaatagttttctgagtagttcctttcggttccccggagctgcgaggagacagcttatttgctgtaaccatattgcatggctaccttcactggagggggttggcaaagcccgccatttgtaggagtcaggctctgctgagtcagaagaaggcagagaggcactggctcttggggaagcagccttcagtgtccaccaccacgagcaagaccccttgatttgtgaaatccttgaggaatgtggtctacattccttgaacatgaccagtgaatttgagtcattctttaaattgaaacaaatcttctccctccaaaaggagggagttctgacagattctcatagaagaaataattaggttacattgctactaaccctatagtgagttgcaaacttgcaaactactgaaaagtgggtcgctgggaccatcttaaccgtctctcttttgatttcccatcattaattctagaaggactactaggtgcatctcgcttatttatggagtccttacactaaagagccatttttctaaaggatggcagtagatgcttattattcacactcgtgttaagactataagctaaggcaaatgggtctacatatttatctataaatggacacttttcaagtgttgctgcattttgcatcctattttaaaggcaaccatgaaaatgagtaaatcttatgctgggaccctggtttcctctggagtctcttgcctgctatagatgagtgcctcctggtcagcttcaaattaattttggtggccttaaggaccatatttttacaagcagctggctcctatattagttgctagtttagtgaagactctggcagtccagaaccaaaggcagcaattcaggagtttaagcagagttaccataccatgtcagggtcaggaacacagaaagctgtgatataataaaatcggagaactggagagcaattctgtaaaatgaactaagcaggtcggggaactaggaagatgaaattccagattgaaatggttccaaattctctgaactcttcaccttaagccctgcttggacaaccattgatcacttctgcagaaacagtatatccatgcactttctcagattgctacttcataatcctcaaatcccagatattctaaattgactctgtgcatttaagtatggtattaaaatcaccagaagttcagttaagtgataatttgcaggacctcccatttaatcagtctctttcttgcttttcccctactcagattcttcatgtctttctttttcattcagtaaatgtatgatcattgcagcctcagaggatgccttctaaagtggtgggttggttggaaatgggagaaaggccttgaaggatgcggtaggctaaaaaatgcgccccccccaccaaaaaaaaagtccaagttgtaatccttggatcctgttaatgttttcttttatggccaaaagggggccttttgtggctacattaagcatctgaaatggaggattacccttagttatccaatggaacctcaatgtgatcacatgtgttcttataagaaggaaataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgcggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactagcctgcacaatgtgcacatgtaccctaaaacttagagtataataaaaaaaaaaaaaaagaaggaaatagagggagatttgacacagacgaaggaggaaatggcaaagtgaccacagaggtggagatgggagggatgtggccacaagcccaggaatactggcagcccccagaggctggaagagacaaagaacagatgtgatatggcttggctgtatcctcacccaaatctcatcttgaattgtagctcccataattcccatatgtcatgggagggacccagtgggaggtaattgaatcatgggggtgggttttttgtgctattctcatgatagtgaataagtctcatgagacctgatggttttataaaaggcagttcccctgcacatgccctcttgcctgctgccatgtaagatgtgcctttgctcctcctttgccttccaccatgattgtgaggcctccccagccatgtggaactgtgagctcattaaacctctttttctttataaattacccagtctcaggtatttcttcatagcagtatgaaaatggactaatacaagatgcttccccagaacctccaagagcgtgcagccctgctgacacttgtatttgggcccagtgaagctgattttagacttccagtctccagaactgggagagcatactcttctgttgtttgaagccatcaagtttgtggtcatttgtcacagcagccacaggaggctaaaataaagggagataaatggcattgccacttttacggtggccatgtcttacaggcaggcaaaagaatgcacttgtggagagatcagaactagaatgcttagaagccatgtgccagcccttggaagaccatgaactggacaacaactgtgccacgcactgccctgtctgctccttcctgccattcacaatgggagtccatgctgggctcctagctcagctctctaggggacaaccctgagtttcaaaaggtggttctttaccatcttcaccacaaagaaaggaaatgaaattctttcaaattgagatgtattttgatgtttttcaaaatttgagagaaagaggaaggaagaggagaggaagaggaataggaatctccagtattgacttaattcttcttattttacatacattcaattaaacagatttaagctccacttacagtctatgttattaaatttgtcgagatgggagatgaaatgcagattaaaaaaaagaagccaatgaaattcagattaaaaatatacattgtatgtgacagataatgataatttctgagactaagtaaccccttacaatgtgtaaaggtgtttgctacgtgtcacaggtattttgggtttagcatgcctattctcgtaggcatcgggtgaagaattgttccacccattatttccctattgggagcacactacacctgtgtttacacagcaagccagtcatttgggaaggttaaattattaatagctgaccttggtgttggtacatcatgaagacacataccgattcaggctctcaattcaggtatgagtatatgtttatgatcagaacatgattttattaattttattgaacaagtaatatgtataaatagaaaaacagtagaaatatattaaattggctgggcatggtggctcatcctgtaatctcagcactttgggaggccgaggcaggcagatcacctgaggtcaggtgtttgagaccaccctggtctccgtatctgctaaaaatacaaaaattagacaggcgtcatggcgcgtgcctgtaatcccagctacttgggaggctgaggcaggagaattgcttgaatccgggaggctgagccgagatcataccactgcactccagcctgggtgacagagtgagattccatctcaaaaaaaaaaaaaaaaaaagaaaagaaaaagaaaagaaaagaaatattaaatgaacaataataatccttttataattattttctcatactgtcagttctacaaccagtccctagatactgtcactttccaccatttctgatttaagtcttctgatatttattcatgtgctttttttttttttttttttttttttgagacagagtctcattctgtcatccaggctggagtgcaatggcatgatcctagctcaccacaacctctgcctcctggattcaagtgattctcctgcctcagcctcccaggtagctggtattacagacgtgtaccaccacacctggctaacttttgtatttttaatagagacggggtttcgcgatgttggccaggctagtcttgaactcctgacctcaggtgatccacccgccttggcctcccaaagtgctgggattataggcatgagccaccgtgcctggccttattcatgtactttttaatatcatgctgatatgtcaatgtccacagactaccgactacgaaggtcaaaatttagctgctttacattttctcccacttccgtctcttcactctgagttacaaaacctataatgctatttcaagtcctctatagatgtgtttcataaccacgtgggaaaattttttcatgtataaatttcttgttccattgattctaaatgcgcctcttgacttgtcactagataatatgggaaagaagcatgcttaaaagactttcttctcaatcccagcttcctactctttctcttccctttaagtaatatttgcaatatttttttcactttaataaaatctctcatcaaataataagttggtttttaaaatcaaaaacacatttacaacattcactatttcattttttaatttttaatttctgtgggtacatagtaggtatgtatatttatgggacacatgacacattttgatacaggcatgcatgaaatgataaacacaccagggtaaatagagtatccatccccttaagcatttgtcctttctttgtgttgcaaacaatccaattatactcttttagttatttaaaaatgcataataaagtattattgactgtagtcacattgttatgctatcaaatagtaaatcttactctttctaactctatttttgtacccattaaccatccccctctgcccacccccaccatccaccactacccttcccaacctctgataaccatttttctactccctagctccatgaattgtttaatttttggctcccacaaataaatgagaacatgccaagtatgtctttctgtgccaagtttgtctttcttagattatttcacttaacataatgacctccagtttcattcatgttgttgcaaatgacaaatctcattcatttttttgtggctgaatagtactccattgtgtatacgtaccatattttctttatccattcatctgttgatggacactagggttgcttccaaatcttgggtattgtaaacaggtctgcaactaacaaaggagtgcaggtgtctgtttgatacactgatttcctttcttttgggtacatacctagcactgggattactggatcatatggtaactctgtttttagttttctgaggaacttccaaactcttctccatggtggttgtactaatttgcatttttatcaacagtgtatgagggtttccttttctgcatatcattgtcagcatttgttattgaatgtcttttggatatgagcctttttaactggggtgagatggtgtctcattatagctttgatttgcatttttctgatgatcaatgatgttgagcaccttttcatatacctgtttaccatttgtatgtcttcttttgagaaatgtctactcagatcttttgcccatttttaattggattattagatgttttcctatagagttgtttgagctccatatatattctgcttgttaatcccttgtcagatggatagtttgcaaatatttactccattctgtgggttgtcttttaactttgttgattgtttcctttgctgtgcattttaactcaatgtgattccaattgtccatttttgctttggttgcctttgctaaatagggtattactcaagaaatttttacctagtacagtgtcctggagagtttccccaatttttttttaagtagtttcattgtttgaggtcttacatgtagtcctttaatccattttgatttgatttttgtatatggtgagagggaagggtctagttttattctcctgcatatggatatccagttttcccttcaacatttattgaagagactgtcctttccccaatatatgttcttggcaattttgctgaagatgagttcactgtaggtatatggatttgtttctaggttctctattctgttccattgctctatgtgtctgtttttatgccagtaccatgctgtttggattactatagttctgtagtataatttgaagtcagataatatgattcatccagttttgttcattttacttagaataactttggttattgtggatcttttgtgattccatgtaaattttaggatagttatttctatttttgtgaagaatgtcatcagtattttgatagagatttcattgaacctgtagactgctttagatagtatggaaattttaacaatattgattcttataatccattaacatagaatatatttttattttttatgtctgcttccatttctttcatcaatcttttatagttttcattgtagagatcttttacttctttagtaaggttaattcctgggtattttattttatttgcagtgattataaattgaattactttctttttttaaattttattattattatactttaagttttagggtacatgtgcacaacgtgcaggtttgttacatatgtatacatgtgccatgctggtgtgttgcacccatcaacccgtcatttagcattaggtatatctcctaacgctatccctcccccctccccccaccccacaacagtccccggtgtgtgatgttccccttcctgtgtccatgtgctctcattgttcaattcccacctatgagtgttttcagattgttcactgctggcatatagaaatactactgatttttgtaggttgatttttgtaacctgcaactttgctgaatttttttatcagttctaattttttttagtgaaatccttaggtttttccaaatataagatcatattatctgcaaacaaggataatatgggcaggtcgagaaatatcatccaagaaccaaggcctagaattggggaccccaagagcccacttagtaccctgccgctttgtggctgagctggtacctaagttgcaacacaaagtgctttttacctttacttctccttttcttttttttttttttttttttttttttttttgagacggagtctcgctctgtcgcccaggctggagtgcagtggcacgatctcgactcactgcaagctccgcctcccgggttcacgccattctcctgcctcagcctcccgtgtagctgggactacaggcgcgcgccaccacgcccggctaattttttgtgtttttagtagagacggggtttcaccgtgttagccaggatggtctcgatctcctgacctcgtgatccgcccgtctcggcctcccaaagtgctgggattacaggcgtgagccaccgcgcccagcctacttctccttttcttaagcagaagaagtctctccctgtagccccacagctgggaatgtcctgggtcacacctgaagccagcctgtctctgagtcttacccaagaccctgagcaagtactgcctgagtaccactgctactgattatttagggcccaagggctccttagtcagcaggtgaggaatcctgccagattgggtttttccattcaaggcaggcacagggtatgtttagaaatgtcatcccagagctaggacctggaatgagggcctcatgactcttcctggtgctctattctactgtggctgagctggtatccaagttgcaagacaatttcctcttttctcttccctctcctctcctcaagcagagggaaagagtctctcctagagctgcaagctgtgctgccttgggtttgtgaagaggtgatgcaagcactcccttggccaccccagctgctgtctcactaggttgtgtgtcccccaagtgtactggctctgagccaagaacagcaccaagacttgcgcaggaattgcagttcttgcggcctagactgcctttcaagttattttaggaccccagaccactttagcccacagtggtgaggcttgctggagctcaggttcccactgctgggatatgcagttcccgaatggctagggctggtctcagtgctccgtccgtgggaattgactgagttctgcctagcgttgctttactctgtgacaaagcaacactgagtttcaatgcaaagtcccacagtcactgcattctccctgccccaagcaagcagattctctgccacacaactgctgccaggggatgaggaaggggaaactcaagactgtctttcccactctcttcagtgctacttcagtgatatgaagtcaaaaccagatactgtgatcattaatctgatttttggttctttacgagctgctttttcctgtgaatagttgttcaattggtgttcctatagagaggatgatcagtgaaggcttttatttggccatcttgctctgcctcctttcaaaattcacaattttatacttaaacaaatatttctgttgtaaatctgaagccatagagagaggaaaaaatatataatcctgtgtaactgaacaacttttcttgaggcattccagtcaagtggacttttcttaaaattcattaatagttacaattggtctattgatattgggaccatgacttacttaaataaattgggttttctcaataattttattggattatttctacttgaaataaactgtccttgttacagacaaaatgaatgcctgcacaaaatatgccaaaataatatatgtatagtagttccccttatctacagagtatccattccaagaaccccagtggatgcctgaaaccatggatagtgctgaatcctacttatactatggggttttattgcacatgtatacctacgataaaatttaacttataaattaggtgcagtcagaaattaataatgataactagaaataaaggagaaaaattataccaatatactgtaacaaaagttacatgaatgtgttatctctcactctctttcaaaataatctcaatatttctagaccatggtcaactgatggtaactgaaactgtggaaagcaaaaccatgggtaaggaggggcctactgtaagtaagtttagaaaggttacagaatgcaaggtctatttacacatattaattgcatttctatgtactagcaacacacagttgaaaaatttttgaaaatacaaattttattagtcagcttgagctgtcaacaaaatatgcagactgggtgatttagaaaacagaaatgcaacaaaagccaaaattggcaagtgggatctaattaaactaaagagcttctgcacaacaaaagaaactatcttcaagagtgaacaggcaacctacagaatgggagaaaatttttgcaatctatccatctgacaaagggctaatatccagaacctacaaaaaacttaaacaaatttacaagaaaaaaacaactctatcaaaaagtgggcaaaggatatgaacagacacttttcaaaagaagacatttatgtgaccaagaaacatatgaaaaaaagttcatcatcacaggtcattaaagaaatgcaaatcaaaaccacaatgagatactatctcactgcagttagaatgatgattattaaaaagtcaggaaacaacagattctggagaggatgtggagaaataggaacacttttgcactgttggtgggaatgtaaatgagttcaaccattatggaagacagtgtgttgattcctcaaggatctagaactagaaataccatttgacccagccatcccattactgggtatatacccaaagggttataaatcattctactataaggacacatgcacttgtatgtttattgcaggactattcacaatagcaaagacttggaaccaacccaaatgcccatcaatgttagactggataaaaaaatgtggcacatatataccatggaatactatgcagtcataaaaaaaatgagttcatgtcctttgcagggacatggatgaagctgtaaactatcattctcagcaaactaacacaggaacaagaaaacaaatactgcatgttctcactcataagtgggagttgaacaaggagaacatatgggcacagggaggggaacatcacacactggggcctgtcgaggggtggggggcaagggaagggatagcattaggagaaatatctaatgtagatgatgggttgatgggtgtggcaaaccaccatggcacatgtatacctatataacacacctgcacattctgcacatgtatcccagaacttaaagtgtactaaaaaaataaataaatgcagaatttcatttctcacacttctggaggctggaagtccaagatcaaggtgtcagcagggttggtttatggtgaagtctcccttcctggcctgcagaccgcaccttcttgctgtatcctctccctgctttttctctgtgagtgcacatatgtgtgcctgaagagaggaaaatagagctcttgtttctcttcctcttttttaagtacagtagtcctaccagattagagcttcaccctctgatctcatttaacttcagtttcttccttaaaggcgctatctccaaatagaatcacattgggggttagggtgtcaacatatggatttgttggtacgtacaattcagtacataataccagtgcacgtggacgtctttgggatggccctgtcttacctaacacagtctgttctctgacccgcaaagattcacatccttctcatatataaagcacattcattcactctaccccaaggtccccagaaatctcaacctattatagtatcaactcaaagtctgtgatctcatcagttcagaactcccaaattttaacactgaaatcatctgaatgagttttgagtaggcctcagggcatactccacccaaagcacaattcatctgtactgtggctctgagaaactggagaggtaaacacagtagtgggacgggtataggatgacagttatagacattcttgttcaaaaagggagaaaaaggagtcactagttccaaacaacttctaaattcagttggggaaactgcattaggtttataggcttgggaatagtatcctagggctctcaggtctgccctctgggagtcatctttcttcttcatgaatggcagcttgagattgtagctgagtagttttataagcatgttttctgcctgagaattttgggggtctgatatggtttggctctgtgttcccacccaaatctcatgtcaaattgtaatcctaacgtgttgaatgagaggctggtgggaggtgattggatcatggggctggtttctaatggttcagcaccatccccctagtgctgtcttgtgatagagttctcacaagatctggttgtttaaaagtgcgtagcacctccctctttgctttctttctctcctgtcaccatgtcacaaagggtgcttgcttccccttttccttctaccatgattgtaagtttcctgaggcctccccagccatgcagaactgtgagtcaattaaacctcgtttcattataaattacccagtctcaggtagttctttacagcagtgtgagaatgggctaatacagcgtccaacagcctttatttgtttcatactccctctctccttttcagtccaagctggcaatgtttctacagatataaattcttaagaatctgcggatcttctatgtatgtcatgggaattcattccattagacaagtggctcttcctaggattcttctagatactttcatctctatgtttgccttctgctgagagaggtttggggtctgtgaatcacacatttaagctcttcaaagggccttttgtgtgactgaatacttaccttttgatctttcaaggtattagcaaaggtttttcagccatgctctcaggatggcagtatctttctcgacagtgaatctcttaatttcagcattttttataatctgaataaagtgacacatttctccaaagaagatataaaaataaccagtcagtgcatgaaaagatgctcaacatcattagcttgtaatattattcatctataaaaaggaatgaagtagtggtacattctgtacgtattacaacatggatgaactttgaaaacacaatactatctgaaataagccagtcacaacaaaatgcatattgtatgattccatctacattaaatgtccagaatagccaaatgtttagagacagaaagaagatttttggttgcgaagagctgaagagagatgtgggagaatagagagtggctgctaattgttatgctaatcttttgggggtaataaaaatgttccaaatttaggtcagtaatggtgcacaactctgaacatactaaaaccattgtgttgtagactttaaatggctaagttttatggtatgtgaattttatctctaataaaggtgtcaagaaaggaataaactaggtagggaaacatatcaacctatccgcatataatcatgtgaagtcacaggtgcctaatgcggtaactcactaaagaaaacaggctgctgaatatattttaaggtttcagtttatttcctggatctaaaagaatggaggtaaggacatgaagagggaatgtatacctttgatgtatttgatttagaagcttaaaataaagcataactacaatttcttagttcataagatgtgctgaataatgctgatgacttagtttctaccatttcaataaaaagtattatgtgactaattttgatgttatgctactagttttcttagactatttgaagacatgtgaatttgtaaggagaagcttttaagataaattagtatctctgtgagactttttatagacataagtctggagtataaccataaataatatactttagtaacacaaagactgcattacaaaaaagtaagcgaaaatacaagcaaaggcacagatttttaaaacaaatgctctcttcattcaaaagaaatgaactgaacatctgtttgctgggccccttagagacatgaagttgcgattcctaactaaaacagaaaaggaaaatatcaagctagtatgggaaatagacttgaaagcaaataactagttcattgatagtagctcctggtagcagaaaagaaagcatgatcaactttgagaaagtaaaacacacacacacacattgtaaagaggtactgactgtacattttcttgtagctcctctagcatcactcaggtaagattatttaatgcaattctcatcccaacaatagttattttgtttcttacatttggggttggatgactctagagagatttcttcagagaaatatgtttttgtgtattttgagtaaatctcacttttgtaaagagagagagtgttcccctgactcacagctgctgccacggcttccttccgtctctagggtttttgtgtatggatgagatgttaccatctcagctctgacctatggattcatatggtgaacaatctgccagtgggacagtttaattcaggaataggtcaaaatccccaaggttcatatggtgatttgcagacgtgctacctggttttaaatttcattgtttctaatctcttgatggtacagcatgatataaatttattctttcattatgataagaatctaccgaggaaataggagtagcacctgcaacacatagcatggattctacctcttttactttaagaaaaaagaaagaaatataattggaagtcttgttcaagcatctgcagtgcctgactcagggcactcaatcaataaatatgctggcagaactaaatgatgtgtttcctgcattctcattgagctttttccttgttactaagcagcatctgtgttaggtccatcgctgacggaacaggctgcagtggtttatttttaagcaaaagtgatctcattggaatttgtgaattaatggtaccgacgttggaaaatggacagcttctttgatttccacctgtttttgtgaagtgttggtaaggaagcaaacaaatagtatccattttgtaggaataacatacaaattgttctaaatacaaagactgctttactctgagcctcagcttgggggtctgtctcccctgtgaagctagccctccataacccttgtctcctttgagttttgaaaacacctagtgcttgacatctgccaaccgattcctcacacatctttggaggagtcatttcacctctcagcagctcagtagctcaatgtaactttccttcctcctcattatggtggggatcaggagagataataaatatcattgcactcggaagactataaagcactttagagttgtcagttattccaaattgctcacaaaagcagaatctcacagaaagtcttggactcttctgggtagattttctttgttaccaagctgagtttgtcagtagcttacctctacctgcagggattgcatgcccctccagcagctatgctcgggtgatgggatttatttctagttttctggtatttaaaatatttagagaaggagttccaaatggttctccaggaattttactatttaacaaatatctgaggaagggaaaggaggctgagaaatttgcattacacattggccaccgtaaagagtaactacatcactgcagatttcagcatgcctttacatgctggtgagctaaccaggccaagtcaatttgaagtgccatggagttttctatagtatatcaagctaaagggctggaaggaactttatttttcagtgatccctgaattgcctttgggatgaaatccaaacagtgaaagccactgccccttcttgcatcgccacctttatgttgccttccagtttaagaaggaagattgagcacagaaatgttccttgttttgatggcaaaagcatgtggaagtgacagcaaaataaataacgaaaaacacagctgcagccgggcatggtagctcacacctgtaatcccagcactttgggaggctgaggtgggcggatcacctgaggtcaggagttcgagaccagcctggccaatatagtgaaaccctgtctctactagaaatacaaaaattagccgggctcggtggcaggtgcctgtgatcccagctactcgggaggctgaggcaggagaatcgtttgaatgttggaggcggaggttgcagtgagccaagattgcgccaccacactcccgcctgggtgacagagcaagactccgtctcaaaaaacaaacaaacaaaagcatagctgcttctttctcaaaaacaagaacaggagttcttcacatacctggattgaaagggaagacatcctcataagaaggaacaggtaaaaacctatggcaggagggaaggccaaatttccatcatcctcaagtcatagagactgaagtcaggcacaacaggagggcttggaaggttggttttcatgagagaccaggggtacatggagtccctgcctgaaaactgggttcatggtcagaaggcctcagatcacatcacccatttgggggaaagggctccagcctaaatgaccaccaagacttagtttagagctgttacctagacagaatctcaaaactgcctgaggaccacccaaccaggggcctctcaagacccagaacacttgtaagacagaagcttacaaccaagaaccacaaagcatcttcagaaaacatccccccataaagcagaaaccaacccaacacacatgaaaaccaaaatccaaagaaatttaaatcaatagggaaaagagaaaatgacattttagatttttgaaataactatcactatgctaaagaagcatgaaactataaaatatgagtagatgatcttgaaaaaagttatttagatatattagatattaaaatgtaattattttaaatttaaatccttagttgggtaatagaacagtctaggtgtattaaaatattgacaagtaggagattgaactgaagaaatcatccaaatactcccaaagtcaaaaaggaaaaacttaagaaaaagcccgaggtgtggggattgacctagaagctccagcacagtccagatgggattctggaaggaggggatcaaatgctgcaggagccatattgtatgagataattactggtagtattcctgatgtgaagaaaaatagtctttaagctgaaaatattactgactgttaagcagaatttttaaagaaaatccacaagtggacattttttctaatggaatttcagaatatcaaatacaatgagagaatctcccttcccctctaggatttcctgttcacattgtctgccacgccaatgccaacacacacaatctcttgaaaatactgcatccaccgacaactttctgcccttatgagccttcctagcttgaatgtttttctctctcctttatcttggctagcagcctctttccttcagcaagtcctcctggaatcaatccctcccactttcttatttaatagtctgcttccatattagcaggacaagccctgttcctctcagccccgtccctgctatgttctgatcattcattctgctttggttccactgctctgtgagcttgtataaggcctttctcttcttcagggctcagcatggtttgtggaatgtggcagtctcctgtgcctgtcattatctcagatgattttgggaatgaatcaaatgataaaccaatgaattagatatcagttgaatgtgcaaatgagccatctaggtacagagaggccagcagtgagtttcttaaggagacagagctaattaaggacagagtcatgtcctggcttgaatggagcaattttgatagcatatatcataatgcctccaccacatactttccctatatagaagtcttaagtgttttaaaaatacctttaaaaaacaaataaaattacagtttttaaaataaaatacatgtatagaaagaaagattttcagaaagtgaatacattgccttttcatcttttatttccaacgtttgtttaaatggcagtcttacatgttttttcttatgaggcacatagataccttaagttgcatggctagaatcattcttgaatagtgaagtttaatcagataaaatgtaaatttcaacatgattattattttctgaccacgtacttaagaatgtctcaggaagttttagacttcttaattgcaagatcagagtgtaactttattagattaatgtctagtaatttttaaaattctcatttattgtcgtgtatatggaagtgtgtcatgtttgaagccatgtgccttttcctgaggctgcttcagccacacctagaaagctcctagagcgaagaaagaacttggtttggtttaatgcactatgttcagcgcccgggatagctccatatacagtcatgtttcacaataaggccaccttgagtcacagcattctgtaattttcaaaagactgctacacacagtaaccctatttgatattcaagagatcagtcaatgcacaaaggaatacatgacttttctgacaatttcagtaatttgtcaacaaccagacccaaaaggaagaaaccaaaagtgacgtaataaaacccatgcaatgcactggggtcctagaagctttgaaaattttatttagagattatttattcctatttgtttatgtaatcctaacagaatttctttctgtttttctaacctgccacagagtttaaaacacaaaattaaaagaggcaaatggttctgtcaaggtcaagaacaacagtccaaaaagcgtaacagccagaaattgaaacaagaaacagacataccaccagacattgaaatacaaaaacacacagctctagagccactgaatgtggaatgcacacagacatatgcacctcagttagcaccaagatcaccccacatagcagcacaacaggaaactgttgaaatgagaaaactgggagtctttgaaaaaaatgtgcaatgatatttagcatcttctatttaagagggcagggaagtaaataagcatcctaggtagataatgtccatcagatgtggtcaagtcaatatacagaggagtttcttattagtatcacagaagtgaaggtggtggaatggactggcctgtaggctcacaggtcaggcatgctgacagccctgtgtcttttcaaagtcaataagtggatttttgtgcctctaatggagagagcctcttctgaggaggagcaaaaactctagaagctttgatctctggaaatacaggataaaagctctcagatttttaaagtctcacccactgacgccattaactaaacatctcatcttgggatgaacattagctgagtgtgttcacaggcttatcccaagtgctttctcctaagccttgtaacagagatgcggcaaggcagaatctggtagtctgtgtacagataattggggtttgatcctgtctgagcaagaactaacccacaacccagagacagccagggacaagtgaagcttatggagaatgaagacctaaggaatattttctgtgtctttgaattctcagcagctaaaatgctgcacttaatgaatgcttcatgattgaccaattacatcatatgactgaggtccattctggatatccgtatcttcctctcgactattcccaccctattgttcataaatcaatcctgaaagaattatttacctctgtgctgagaaatatgatcacttacatgctgcaggtgtgggtgagaaggcgtgatgccgttctactgaatcatgatttccttagcataggttttgatagtttaattaaaaacagaatgcaagactggcttttatccccattcacttatggacgtcatgtgtgttcccatccatactatttataaatgacaatcagaatgtttatggtcctctcattttactaattatgaaacaagcttaactctttgctttttatttttttctagcggaagataatagtctgtctcaaaagaagaaggtcactgtagaagatctcttcagtgaagacttcaaaattcatgaccccgaggctaagtggataagtggtgagtccaggtccttcgtgcacaagacatcgcttccccatgcctcacccccactttcaataggttgggtctagtaatttgcctctcggatttccccctttggccacagaaggggatctacagagcttttgctgtagtcatcatcagattatcattctatgaaaatgtgtatctggtaaaatcaggcttttgtaatggtgttgcctcccgagcatccacacagccttcacttaatgagaaatgggtctgctgaagacgtgtcctttgtgtgccacctcccagagacatcatttctccgggggagctgtggggtgttgcttagcaacaggaacagtgcagggcacggtgagctttccttccttctccacaatcttcattcccctttgttctcttgctctctttccgttaggcagaaggaccaaaagcaactcatggagttcttgtagaatagcttccaaatgaaacttggagtgctgtacacagatgcagattcatttattttccctgttgaactttaatttggattaaatctactttccttgtatgggggattttttttttaaaacaacagaacaaaatacagttgggggcagaaggcatatgttcacaatgcctgtgttggttcataacataatctatttcttctaattgggtctgaaataattcaagtgcatccatggaagatgtacccatccctccacaggccaagttgccagcacctccctgttgcctccattgctgttgcttacatttcatctttgcttcagtggaatacacttgaaggtttatcctcaggccagagaactttatagtgatcaaagtctagttcagatccttgcttttataataaatgaggtccagagaggtcaagtgacttttctgaggtcacagagctgatgagtgcgagctgtggctagcagcccgtcccctgacttccaattcagtgctcttcccaccatcctcttttgctgagtgatcgagtgtcgttgtatgtttttctgtcaaactgcttctaaaatgcttttcatgcttcacaaactctcagaaatcaattaacaatgactcttggctgttagtctcctgcttaggggcaatcacttttctttcgtcctctattgtggcttcagtattcatttctgacccttagattagcttatttaaaagtgaaaaaagtaggtggatctcagagggaatgtattttagaaaactggggagaaattagagcagcagtatatcatgaataccaagggcacacagaaattaaaaaacaaaacaaaacagcacagaggtctttttgtttggtggaggaattgactttgcctttgttttcggctgacctgctgaaatgttcgtgttcgtgttcactgtatgttcgtgtacacccgctgcatcagcaaatgcaagcacttgtgggatgccacaggtagaccttgggaggaaaacatgacaactctccttgaggagctcaaagttgtgttggagacgtatctatgagcagccagtgggaatcctaacacacaagactcagagaggaggatcggaagttctcatccttctcaaaggatgtcccagagacagtgcacaaactcagtcttaaagcgatggctaggagcttgttagagaaagctaagaatagagccctggaagaatgttaggtctagaatgttagtcttgctaaaccctggttgggggaaccaaaaccaagctgagaaacaatgcccagcagttacaaaaacaaaacaaaacacttagacttgtggtatttaagaaaatgagtgagcacagtggctcacacctgtattccagcactttgggaagccgaggcaggcagatcgcttgaatccaggaatttgaggccagcctgggaaacatgttgaaacgtcacctttataaaaaactagccagccatgtgggacctctggtcccagctacgtgggaggctgaggtgagaggatggcttcagcctgggaggtccaggctgcggttaactgtaatcatgccattgcactccaacctgggtgacagagcgagaccctgtcaaaaaaaaaagagtgaactctttggtatttgtcaaaaaccaattataaaggctcagttaatcattgcagagttacttcattcactttaagctattacgtctttagggagcaggtttgtccatggaactgtttctcagtggtatacatgggagtcacaccacccaccaccatgatctcccaccaccaccaccagcagcaccagcaccacaggcttctctttctgctccttctctgcttctccttctccttctcgtggagaggcagaattcaaggatgaatcaagaggccagaaacaagggacaccaaacctgagctctagggttcagagtaggttggaggagggcctgggaagacgccatgatatgttgaaataaagtgtattcatacctataaggtatatatttttattagaaagcccatggcatcagacttggcctaaagcagcattccatgccaaaaaaaaaaagtatatgtagagatgtggagacacaagagcacagatgtttctggaggaacgtgtgccagttcatggtataaggagtttgatttttatgagcaaatgaatggagtctgcccagagaggcactggctttctggccagaggagaccagccggattttctttatatccgcaaagctgggagttaatacacgcaattgagacgtggctatgtgcccagcagaaaatgcccagcctgcctgtatcatcaggttatgcctattcataatgaccacctgcagttctaaatggacctgcctttggtgttgaggagctttcttaggatgattctccctctgtaaatgtacacactgaagaaactttgctgtgaagtaaccaagtggttgggtccccaaatacaggtttgatttggagtgttttggaacctaataattccactcacacatgaccctcagcttccccttacctttttttttttatcttattcctcttcctaaacattctctctcttcccgctccctaaagaggcaatagcttaaagtgaatgaagtaactttgcaatgatgaacggagtctttataattggtttttgacaaatactatagagttcacccatttttttttaataccacaagtctaagtgttaagatctgggaaaagattactacaaatccataggattatctcatgttgtagagctgggatgagccttagaaattattagaacattaattcattcagtaagagatttttgagtgcccacagtgtagcagacaaattgctgggcccaaaagcggtgagcgatttgttcatggaactgtttcttagtgatagacataagaattattacccaccaccaccatctatcaccactaccaccatcacagtctcctcttcctcctcctcttcctcacatcaccgtcatcatcataacatcatcatcaagatcatattatcatcttcattatcttctgggtgtttactgtgtcttaagctctaggctaaatgatctatatacatatatatatatatagacatttaattaccacaactacaatgattcccattttacagatgaagaaactgagtctcagggtattgaaataacttgatcaatatcacaaagtttgtaagtagcaaaattctgatttgaacctaggtctgtctggtttttataaactaccctattctggataaaattcaggtctcctgccaatttcttttgcaaccttagtagttacattgtgtattttaaccaaaattataggttccgaacagttcagaataattgccactttttgaagtctctattctagctttctattcccatagtgaccatgtcaaagttacaaaatacgcaagagatgaagaaaaatggtgtaattctctacagaggaagagacttgattttgttttttgtttgtttgtttgtttgttttttagtacacattaactgctgaagttaacaagtgtaccttgggtttaatattggagttaacagtctggaactaatacgctttatttatcaggaggaaatgtgttaggttggaattgaatttcccttccctcatttttatactgtatgcttaattttttaaatctaccttgtctgaaaatgattggtacaacagcctcacattctctaacatcctgaagaccttgtagacttccttacttgtttgttgcaactactggggcaagccaaatgaggtgtgtaaagccatgaaaaggcccactctgggccaggtgtggtggctcacgcctgtaatcccagcactttgggaggccaaggtgggtggatcatttgaggtaaggagttcgagaccagcctggccaacatggtgaaaccctgtctctactaaaaatacaaaaattagccaggcgtggtagggcacacctgtagtcccagctactcgggaggctaaggcagcagaatcactcaaacctgggaggtgcaggtggcagtgagccgacattgcgccacagcactccagcctgggtgacagagcaagactccatctcaaaaaaaaaaaaaaaaagaaaagaaaagaaaaagaaaaggctcactctgggctccctctcaaagaggtgcacactcccagaagtggtcacagcattgcctctccaagtatttgctccattgagtaaattcttatacctgttataacaaccgcattgcacttcttaaccttttggagcccctttgtgccattctgggactccactctaggggctgtgatgagatattttggttactctttgtttacatggaccaatcatcctgggctcccctggcccattccctctttctcatttctagatgatgataattgcaaatctcaccttctctgcccaaccctgcaaactccctccccatcctccttctcagctgaaactgccagaagagagcttaggaacactcccactgtcctgtcaactggcctcaacactgccgctggctcttcctgcaccactcccaccccgcccctgccccgccccacaggtgacctgtctgctgtctgcactcaatctaaaggaaccacagatgcactcgcttcacttacctgaggaatcattacagcaggcccctcctttctcccctaaatttttgttctgtattggctgattcctatcatgaacgaaatgtggtcttccttctcttaccttaacacaaacacctcatctcaagtccacatgccctgcctggctcggcctggcttccctgttcccctttgcagcctgaagcagtcttctatctgtaacatctccaggtactcttcttccactctccctaaatccactcccgttaggctaccacgcccagcactctccgaaactcctcttgtcaaggtcagagatgacctccaggttgctaaatgcaacaggcatttctcagaccccaacttattttacctgccagcagcattggacaccattgattcctcctctgccctggatacacttttttctttcttgtcagctcatgggcatctcctttgcaggagggttggccggttctccctcttctccctgacgtttaatattgctgcaagactcaggacttgttcctctccttttcatggctgcacgccctcccttggtgtctccctccagtcttatagttttaaatatcctccatttactgatgattcctaaacatatgtcatcagacaaaccttctctcaaatctctcagatgtctgagagacatttcaattttaaccttaatatctccaagtctcagtccttgatttccccccaaaaccaaaaatacaaaagaaaaaaaatccaccctatccacaacctttctgatgtcagttgatggaaaaatttgtagaacaagctaaggaccttcaagtcatcttttattctactttttctctaacatcccacatccgatccatcaagaaatcctgccagctctgccttcagaacacacgtgcccatcctagcctccacgtgatgtttgggtgcatgaataccatggcagacttggcatcagtccactcggagggttggagggctggactcaagcccagcagcagcaggaaggaccgaggctctactccggcacctcaggtactagctcaggtgcaaggagaaggggatgcttgggtgactggggtggaattttaatgtttctaactttaaaagtctgaattcctcaagtttctcacttatcctcactttgtactccctgaggggaaataattcacccccacaatgttaggtattgtctatatgatgatgagtttcaattctctagctcaaatgctcttccgagctatacacttggagagagagagagaggggtgtgtgtgtgtgtgtgtgtgtgtgtgtctgtgtgtgtgtgcatgtcagtcactggctaatttccatgtccactgcagtatcttacattcacctcacatcctcatgcccagcactacatcatcctcccccaacctcttcacagaccccccgctgcccactgtgcgagcacagccctggccccccgaccctccatgtctcagactctacatgatctgtttactctcctgactcatcattggccatctccccagttttctcttaaactttgcctacgtgaacttctttggattgcttcagaagtccatcttcttttcccccagagtggctcttacataggatgttccttctgtccagcccactcgctctcctctccgcgtccacttgtgatcactcctagtcaccaccctgcatgttatctttttcctttaagttgctccctaattcttgctctgccccacattgactcttctggttttggattctcctatatcctgcactgacccttttgttacataggttaagtataattatttatgaatgtaaactccacaaggatgggactcgcatctctgtttactgtggtatccccagcaccagcaaagtccccagtttgtggccgtccacgaagacttcttgggcattttctcatttgatacttaaacagcctagttttaaagataaggaaacttacaagcatgtgatttcacatagaatggtggaaatcttttctgatcatgtgatttgggggcagggacctgaaggtgaggatcatgcagatgagttctctgggggaaagccttccaggcagggtggaacaaccaacgcaaaggtcttggtgcaggaggctgcttggcatattcatgaacagtgttgagcctgagggagaagagccagagataagatcagagtggaggctgggaccaacacctacaggctctgtggcaatgaagggggcaaagggagtatgggggagaatttagagaagctgagaagttgggtttaacttattggcactgaaggttttagaataacaatgacatggtgcaagcttaggctgatatatcaacttcttgtattatatatactacacatttgttatatgtatgtatttattacagtaaattagaaatcagagattaacacaaatttaaaagatactaaaaattacctgtaacccctctaactgaaaatggccactattaaattttcatagctctccttccagataataacatatattgaataatactaagtgtattaagtaggaaaatattcataacctatacatacatatattctcatggcagtaagtatacatcgtcattatctttttaacatcttaatagtatttcacgatattaatgtgccttaatttgcgccatcttctgatattgaaagtttaggctgtgacaggaaaggaagtggcaggtgtaaaaagccatggtgagtgacaaatcagcaggaggtggtagtgtatagaaatggaacaccagggaagagagcactgtcaaggctgacttgaggatctcaggcctgggcagctggaatggtgattctctattcttgacagggagtcagtttctgtgactggatgaagagtttggagtggaagtctatgagcaataactcggtggaaatgttcgttaggtattgagaactggggatgaagccaggtgagaggttggagccatctggaggaccatggaaagcgtgggttgtggaggtactgctcagagcctctcggagggaagaggggaagagggacacggaggtgtctgaggaagtgtggtcagggaggcaggaggagaacttctaccacgccacgtcaaagtcaaggcaggagaaaatgctctaggcgagttagtgtgctgccgattttgtaacggcagatgtaaatgaaaaaccaccccacggtggccacgcacctcttcctggctcacagccccagggacgtgtttgtgtagacaatagtggtgatcatttgagtcatatttaaattgtttatttctttctgttaaaggtaaactgaggcacaatacaatttttttttttttaaaagcatttatttgagcaaacagtgattcatgaattgggcagctccaaaccagaagtggttctggggttctaccaagggaacaagggagaaggcttttacagaacaaagacagaagcaaagcaactatctgattggttacagttatggagttgccttatttggtcaatcctgttggaaagttcttagttacagaagttagttgggagcttctgactggttagtctttaagtttcacttttctttaatataggcatttatgagaaaaagcccaggtgaagtttttgtttcgttttgttttgctttgcttttgagacggagtctcgctctgtcgcccaggctggagtgcagtggcacaatcttggctcactgcaacctccacctcccgggttcaagcgattctcctgcctcagcctccctagtagctgggattacaggtgcacaccatcacgcctagctaatttttgtatttttagcagagacagggtttccccatattgctcaggctggtcttgaactcctgacctcgtgatctgcccgcctcagcctcccaaagtgttgggattacagatgtgagccaccacgcccggcccaggttaaattttatttatgtttgcaattcacacaaggtcaaggttacttacacttacaaggccaactggctttgtctccttgaggattctttaggccttttaacttacttttaacatcactaaccacactaatttatatggcaaataccctcttattgacactgttgcagactatagtaggggaaaggttaattccagaagcagggtgaaagacgcttacatgcagacagctttccaccctctcctcaccgcatctgtgaccaacagaaagtgtctcctctgtcttaacagaatttgtcactctgctcaggtagctgatgccactgcacctggtgagccacctagctcaacaaacatatttgcttttacagatctgccttttatgaaggcagcctgggctaaaccttggaaatggtttgataagccccatgccctgtgctctgagcaaatcgaagcctcctgcatccttcaaggggtcccctctcctcccgtctcctcccagtatctcttggatgcaggcaggcctggagctgattgacagaagctgctcgctgggcctgattaacttgtctgctagctccaggcagagcttggcctcacagcccatccggctcctgcctcctccccgccccctgcagcatgttcaactttagtctgaatatggtgatagaccatgtggctggcaccagcatctctccactgtctgtgtttgtttacgctcattttcattaatccagccacttgttagcagagagccctctgtgtctctaggatgcggtactagagagactgtaaaattgaagaaaattgcttcctttgaatggaggaaaatatcagctggctggttgatactggaaaagtatatgtttcagaagataaaattggagttagtgcacagggctcaaagcaacttgatttccatatgtgctttatcctcttctcttttgttatgctgaaaaaacagatgggttttttttttaaataaagcttatggggttaggtagaggggggaattcaagtttaaaatggtttgggtatttccactgctttttggaggccacatttttcaatcaaaaccattaagccttagaattgcagagagtaataaagtcccctcgagggcacttggtacagcagcctgtatcccatggccagcagggacttcagggaagtacccaggaagggcaggcttcgtaagagggactgtgttctcccacggctctgagagtgtttggagagcataacagtgatcatttgaagtcattacataaaaatacacactgaagcacatcgttgtaccttaatgaagtccttaagaaataaacaaaatgtaattatggtttacattggtgtaaaccaccagtttattttttctctcttttgttgtcatgctcaaggtcgcacctttccttaagagaagagagcctcagttgtctggcattaggaacccaatcatgtctctgactattttcgtgcagtaaaatctgtccatgccatcactcccattttttctgcctaacacagtttcaacagtatcctgtctgcacggccaggcttatccttaaatgcatcttccccatttctggtctctgagctaagacaattatttgcttaaacttctgcaaaagtttcctattggagttttctataggacctacgggaagaactcaaaagacagtatcatttagcgccagcagcagcggaagcaataattgcaacaggaattgaaaggataacagtagctgcatgaaatatctcagttacttcagttcagtcttcactgaaacccatggaggcaggaattttttttttattatactttaacttttagggtacatgtgcacaacgtgcaggtttgttacatatgtatacatgtgccatgttggtgtgctgcacccattaactcttcatttaacattaggtatatctcctaatgctatccctcccccctccccccaccccacaacagtgctggagaggatgtggaatttttacctttactttagaaataagaaaactatgagtcaaagacactaaatcactttttcaaagttaccaagatggctttagagaatccagggtgttcctgcctcagtgtaccttgcctccccggtctcctcaccacccctactcatggcctctattttgttttttttttgagatggagtctcactctatcgcccaggctggagtgcagtggcacgatctcagctcactgcaacctccgcctccctgattcaagcgattcttccgcttcagcctcctgagtagctgggactacaggtgtgtgccaccacgcccagctaatttttgtatttttagaagagacagggttgcaccatgttggtcaggctggtctcgaactactgacctcgtgatctgcctacctcgaccacctaaagtgctgggattacgggtgtgagccaccatgcccggccactcatggcctctattaccacgttcctggccatattaggttctttggcagctttgtgactttattgctcttctctttttctgaaaataccgttgctcatcacttctctgcttcagaaagtctcattaatcctcatggcttgacccaaaatacattctctctgattttccaaattagaattagttgtgtactccacgataccgcagtagaactttacaaaacttcagtcagagcatcagcttgtgaaccagctagggttggaccaccttggggatgcagcccacttcgcagaggctggatgcacttcctccgtctgaaagcagagagaggtgtgtcttggggcagggcagccgatttcttccacaccacgctggtcccttccagaggtgctgtaggtcctctgcctgtaggtcctctgggcggactctagttcctaactgatggatgatgctgggccccgctgttgatgctgcttaattcataatttggggactcaagtctctgcaggctccactgggccaacttgcttcctgcagagatacatgttcagactctactaattacttttccttggcaaacgttgcatccctgggaaatttaaatacaacttccatctttgttgactccagtttagaccccggccaagactgaaatcgcgtttcaactttatttgtttgcagtatacagagggacaggctcttctttttttgtttttgcttttttgatttagggaaataaatatttgattttgtgtgtatatacgtgtatacgtacatatttttttctcttaagtaaagggatctcatgtgagatgttcatgtttttttcctactctgataagtagacagatattctccaggtcattatacggttgtttccagggctccaaggatctcaagaaataatcctgaagaccccgccgtactcagcccctccatcctcctacctaatagagcagatgacaggatacgccgtgcagcgtgccttgtggccagcctggtctttcttcaaggtcaagctcaaaatcaaagcctggggcaggcggttttctgcctggcaacgcagctcagccccagcagcccacagaccaggatgcaggagtttgttttactttagttccgttccaattaaaagagtctgagagctcaggtgaatcccaatgcactgtagctgtttggcccaagggtgagattctgccgcgtcctctttttagagtgaagcgcattcagaagacccattaattagagactattcatccttcaacacgatgatattcacatgagcactgacaccaccatttattgtctcagttaaattacttcacagagtccttaaccatggtaacctgctagggtctaattaattatcattgacatcttttcaaacatcgatcaccttcttaattaataaaaaagactcacttgatctcttcggtaactgagcaccgtcccctgtgactcatcaatcttttgcccacagcatgtctcacttcacattcaggtgtctgtctgcatctctgtctggctcttgacagcaaacatcttgggggtcacaggtatgttgtagtaattatcatagttccctcataggtcacagtatctggggtgggataaagtctcaataaatattaactgattgaatgattcagcaaatgggcaaattgagtctccagagaagaggcctctgggaactgaatttttggttaattgagggctggccaggctctttattgtaactcttcgtgttttaagaaagtagacacacgtgggcggggcgggacgcagtagctcacgcaagcctgtaatcccagcactttgggaggccgaggctggcggatcatgaggtcaggagatcgagaccatcctggctgacacagtgaaaccccgtctctactaaaaatacaaaaaaagttagccgggcgtggtggcgggtgcctgtagtcccagctactcgggaggcagtgagccaagattgcgtcactgcactccagcctgggtgattgatagagcgagactctgtctcaaaaaaaaaaagaaagcagacacacccttgtaataagaaacgcacatctgattctattttcttgctttaactgggactctctaacagatgaaagagatagctcctgctactcctcatactagatgtgttctccatcgtaagtttgatacttgccacttattgatcatgtgcagaatgtgccagacatgatgctaagttcttaatcacttagcatcccgtgaaagacaggcgaggccatcgtctctacacagcccacatatttacaaatcttccaactggatggggccatccagaaacacaggcatgaagctatgtcctatggaaggtactgtggccttttaaatatttggggtgtgatatcatcctggtctcttttccacctaaatccccgtccctcctccatcctccatcctgtgcatcactgggacctcatgacgtgtttatctctcagcgatactttgctaccagcactgcatcttctctgttttccaaaatacactaacacaaacatgcttcataacagacatttacaaaaagtgacaggatgacaaaggagaactgtgggtaccacagaagatgaagcaacaccgatatgaacagcacggcttgctcttcttaaagcccctagacattcttgcttaagagaacctttccttgactgcccctttttctcttgtttatggggtcttccaacaactgcatggcctggttgtgctgcggttgcttctatcacagaacttttccgtagcccccattgccctaaactgttgccaataaagaccaagttgggattcagggatatcgaagtgaatcagagttctcttcaaacttagtgtgaatctcatgttcacatttaaaatgctttaggggcccttttgtgcagggctgacacccatatcctatgctcccttcgcaagctgagtatttgcaggacgctgttctgagattggtgtagacctttctaatatccggcactttgcagttgaaatggaattcgtgctttgtggtgtcttttctcatatctctttagtgtaaaagtggtagaaatgtgtagaaatagatatagcatctggatattgtgatgctgagcaggttctgggcttttaaacccagatttccaaaataagtgccaacctcacatctgatgcttctgccgagtgctccctggaacccagcctagaccgtctcttgggtcaggatcttctgttctctctcaagaccccttattcattccccctcttctctgaatattttgggatcctctgaaatgtcctccctccagaaaaaaaaacaggtgatagctctcagattccagcaatttatgaagcagattaatctagctgtgctggtcaggcctctctcctgtgctcctgcctcaggtacctttctcaaggatcaacaaaaagccaaatgcaggaatttccccaaacgaaagatacgtttctggaatttctaccctttgcgaggcaaggaaccgacatgtgcattcattttcttaacttctcccagatcacattcttacacaggacaacccaaagaagggaaagatggaataaacctcggaagttcaaagtagcagaatgtttcttatttacaccagtgttacagatcaggggccctagaatcagagaagttaagtcacttaccttaggccacacagctaataggtgacagagctagtctttactttgaaaatgcttctgacaattctgaaaacatgcccaaagtccagtggaaagttatgttcactaaatacaacggtaccaattaagtcttcatagggttgaacttgaatctgcaatggaaatctggaagtatctgtgaaggatgagacaacacccccaggtgtctcttcccccggctccctcgtgctctctcaagatcagcccagctcattagtgcagcccgtggctacatccaaagcacgcagccctccttgctgcagtcttttgcaagccaggcatcctgaaggtcacagcagaagtgctgtggggtaaaggatgagtttgtcagcagtgccccgtggctgcctggggctctgaagggcagccagatggagtgtgagctttgccttttccaccagatgttatttacttatttttgctgttagcttctcactcccatctcaaacacctctgggcaccaaatacttgaaagtagtttgtgatccgcaaagacaaattcctaataaaagtctgaaaataaaataatgttgctggagaattatttgggatacttaaaagtgttgtgtgttgtatctaacgtgttgctggtgttttccatacatccatgctagctgcttgggaattgccgagttctgagtcaggaattttaatgggcacatttattcagaccctgagcctctgctgcttagttctcaccagtgataacatagtttacagagtgacagccggagaccaggaatgaagctttataagtcattttaattatttgatattacttgtaagttgccgaaggaaggagactcctgtatgactatactgtaggtgtctatttgcgacacaccagtgaacacgcacgtgcgatatacaaaggacaaaatgcatgtgtgatggtcagcgactgagaatgcccctttctggctgacatcagaggggtgcatggcaacaaaatgtcatcccaatctctcatgggatgttttcttttccaactttcttctcaatggcttctgacattaaaataggtttttactgaatataaagtacttatgttcctcaataaaacccaaattgttgggttttaaaaacttaatgttggattaagatctcctaataagcaaggttaaacaaacaagggggttggaaataaaattagggagtgccaatttaccagctgctgtgcgttagcaacaatggccctgttagcgctcccccaggttcttcattaagctcggaaaatccttactccctgattgctcagatcccacagatgagcctagaagaaagtattaaatgtctaagaaaagacacaacatattcaagtctaaaaagatgtttctatttcactttgaggctcaagtaaacccatcccccgccccttgttctcttcccatcatcttcctttgccattggagcctacaattcgtccagaatcctttcctcctccctcttttgaatcagtccttgagacagcataaaagaagaacaaaagctccaccttatcccatcgccatccacctgtcttacatacttgaagaacaggagaagataaataagatggcccagcatggtcattttctaatttttatggagggacttgaatttgaaaccgacaccactgactgtgatcatgcccccagcatacgaaggaggattttcctttgggctcccaggcagatttaggcaagttcctcttctctgcctgccgtgacctttagaaatcatccactaatgtgtcttttcatgacttcccttccagcgttaagttccaggaacttaatctctttaagtgatttctgtccaagctcagtagctcaaggatcccataatgttaccaaaaaagactaagatctccatggttctagctgcatccaacaatgtaaacaggtaaagtagcatccttggagcatcttttattcactttataaatatgataaaagtgctgctaggtgcctaaagctctgatttgttagatgacttgggatcacaaaggcaaataagacaagctttgtaccttgtatttagagcagaaggtatattttaaatgttaaaagccatcgctttatttttatttgattatgctgggggctgaatctgtaacaccttgtatagcacccaggaagtattagttaagtgaatgcatgcagacgcacaccacatggttccagaaaggattctgggcaactcagtgcaaacatcagatagcaatatcccaaatcccaacaactgcaacagaaagaaaataggagaaaagatgagatttgtgcccgcagtgcatgttgatttaataggaatttcaaaagaaaaaaggacgtctgtggccaggtatatatccaaagcctgctttctccttctcgcctcacctctgctggcttctggagctcacactcgttcacctcgtccttccctcgttccacccattccctattctggtgggataccgcaccgggtgttatgagtacatcagctcatttgatattcacaaccattcctgctggctggtggtatctccattttacatatgaggaaactgaaggttagaaaggctaatgaggatcacaagtctcatggctagtgtcataagagagcagatatgacttcaggcttgtctgtctccaaaagccttcgatgtggaccctacaccatcctacaaggaggtggttctctaatccgggatgaagctcttgttcttcctgtttttccttttcctcaacatatgaggatttgttctgaagatcagcagtaaaatctcactgaagggttgaggcttgttttaaacgagtccagaactaagatgtaacccaaatagaaaaacagtcagtaaaaatccacgaagctcccgcatccctcttcttaaacatggcccagtgacccccgtgtgcgggttaaactcgagattcctttagaagatcgtgcttcttatataactaggactaatgaaagcagcctggaaatgagtgcacagtttgatatgggacccatcaaagatgtcattcagcctgaggataatgacccccaaggctgctgcaagagccatgtttgagctagagccagatctccttgaagtttatgcttcaataacttcgttaagcctccttggtgcttttgggtcaagcatgactttagtaaatgaattatacgttggataagggtcattttgtaagtgaaccaaatgatgataggaaagtcattctctgcccatacttatggtgtcatctgtaagcacagacctgcaactttccgtggttcagtgagactgagaccctgggtaggtgcactcatcacaggcctcacagggagattttatttaaattgacacaaagaattgaggattggtggcccatcgttttatttgaagatgtagacagcaaaactaaaatatttggatttcttttgttctgtaaaagatttatttttatgttttgaatgcctaaagagagaaaatagttattgtatgatgatggtcatcttacataaatgaaaataccatttaatgacatgaatcttattcattctaagaaattaaaatgcctgtaatcattcatttatattgttgccttgttatttggctttcgtgaactgtgtaaaaagttgtgaatttttaaagaattcaagagcaggattccgtttctggaattcaatatcggtcacactgtgattgcgaaacctctgtatacggatgcaggcagggagttttgttttgatttggtttggtttatgtgtgagcaaaatgtgtcatagatctgtagaaactatccaattttatagatcctttcaaacatggagttgccagacttctcctaggaattgtagcaggtaagataagccaagaagtaagaggaccatctgatagttcttatcttacttagatggaaagtggaaagctcatggaaactagaaatttttgtgtgtgttggttcttatttattaaaagatatattgccggatattgtggcttacacctgtaatcccagccctttgggaggccaaagccgaaacatcgcttaaactcaggagtttgagaccagtctgggcaataaagtgagaaatcatttctacaaaaaatttgtaaaaattagccaagcctggtggtggacacctgtagtcccagctactcaggaggctgaggcaggaggatcacttgagcctgcgagggacaggctgtggtgggctgacatcgcaccactgcactccaccctaggcaacagagaaggaccctgtctcaaaaaaatatatattatacatattttttattatatataaatatataatatatgataacatatatttatatatatatgtatatcacttgtaagcctcagtagtttaatattactaacaaacttcacagtgacacatcacacaaatgatctcagcatcctagaacttaaaatctaggatgaatatgttcttataatttttgtttctttctatatttcagataaaactcagatacctaaatttcatgatagctttctccctgggaaattatattctcttcttattgcaagcaccacattattgatttccctgatacctcattaccaagactcttttctgcaagagaaaagacgctgagtactttatccaagtttcacatcaggcccagtgatccccaacccactgtctttccatcaatttgcctcctccaagtcaaccaaatgcattcagttaataattgaaaaaatggtataaaaataaatcaggcatgtatagacgttgtcctcaggtacttgcagattaagggagggagtcaggtaaatggttaaagacataacaaagcatgggtgctttctcgagatacagacagaggagggagaatacagagaaatggcagcttcctgctgtaggagcttagagagagtctcgtggaggtgacatttgaaccaaagtaacatttgcacataactaggacattgccatgtagaggcgtctggtatgaggagggagcagggaatttctctaaatattgcaggtaaaaaggtttaggaaaagagttgtggcatatccagaaactgatcagaatatggatttggcttaagcctgcaacattcagtatctggtaggaaatggggccatgagtgtgaggagaagacagaccctcagggcgtttctgcaggcccctctctagcagctggggccatggtgggctctgagtgatgagagctttttatttcttaaatgatgagggtggagtgtagatagtgggctaggagaaagacatgtatatgtgtttggctttggggggtttgttgtggtttttttttttttgttgttgttgttgtttgagacagagtcttgctcagttgcccaggctaaagtgcagtggctcactgcaacctccacttcccaggttcaaacaattctcatgcctcagcctcctgagtagctgggactacaggcatgcgccaccatgcccggctaatttttgtatttttagtagacactggatttccccatgttggccaggctggtctccaactcctgacctcaagtgatccatccaccttgatctcccaaagtgctgggattacaggtgtgagccactgcggccggcctgtatatatgttttaatgagtcactttctacataaaaagttatttgcaggaaccagtgcggggaggtaagaatgacttaggcaaatctccttcttttaataagcttggagtccaacaacaagtgggcgagtcacaaacaccaacagctgtgtgtgtacccagatgcaggaagggacacagaaggaaaaagacacactgaacatttggcacagcagtgcattgagccagggactgtcagagctgagtgctgtgggcctctggtaatgaccattaaacaaacacctgccagaaagaacttctcctccactgggattcaacaatagggaatacctcatccagtctacctattcgtaatagacaatttagtaggcaaaatcttaaattttcataaagaagaatatcttaagagttggaggtttcacacatattgtatatcttaattttcaaggagatgcctatgatatgtttctaagatctttttttttcctctctggaataaatactagtgaacttaatttatttcaagaagaatacagatgcacctcttaaacatactacatacactccatagtctcagaatccaagactgcaaatctcctgtctaaaaggaatgagttaatttttgaaaagcagagtgaagatgttatgacataaaagctataaaaattcacttaatttaattaacttgacccgaaggggagctatgtgagtccagagacttaagattttttttactatgtgagaatatcccattaccaagtgtcatatatttatcccataattttcagcatgttttactgtggggttactcctcaatggcaaatgttccctgagcacaatgaatggcatgcgcccgtggctagaccccacaagaaagtcaagctcctttgaacccacagtgtgctgggggtcttcgactctctggaagaggttttgtgaaggggcctcttcaacagaaaggggaaggagtccttttggatctgccccatcgttaccatccagcctgctgtggaacaaaggagaacagacctaacgcctgtgcttggaagaacttggaaatgtgtgctgggaaacaggatcgaggccttccttagtgtcacttcataacatagaagtgttcacgtgacacctgcttgtttagatgactggtgtagctcaatcttccatgattacagctacagaattttggatatgcttttattgtttagcctagaatacatttagagaatataaaaaatttactcccatctttaaggaggttacattctggctcatccattcactcatgcagcattgtgttgaggacctactatgtgacagggactatttcagccactgggataaaaaggtaaagaaagcaaactccctccctccccccatgaaccattgtaggttaaaatagcccagtggtatttttcagagctcaataccaggcagaactggatgtaaccttcacaaacttggaattccatctcacatctgacagactaaaaaactaaaatcactcaagtaacctgcccaattagagtctcttctagtttgtactataccttcaacctggagttgagactgaggaaggcggaggaaggtgagaagaagggagtgttggtcaatcctcagaaaaagaactaggacaggctgggcatggtggctcatgcctgtaatctcagcactttgggaggcccagttggttggatcacttgaggtcaggagtttgaaaccagcctggccaacatggtgaaacccccatctctactaaaaatacaaaaattagcaggatgtggtggcgggcatctgtaatcccagctacttgggaggttgaggcaggacaatcatttgaactcgggaggtagaggttgcagtaagccaggattaaaccactgcactccagcctgggagacagagtgagactccatctccaaaaaaagaaaaaaaaaaagaaaagaaaaaagagctaggataaattagatcatcattcacagcagcatattcacaatagtatcaaataaaaaattttgaaaatagaataaatgtatgcccattttttaaaattggcatgcatttcctgaatatgcttagaggaaaaagcctgggaaggaataaaacaaagggtcgtcaatatttatcttctaggatcaggcatgctttttttctttcatctcacttatctccttacagcatccctgacaactggacttacctgttttatctttataccagaaaccagcccactctaccaggccatgcaaggtctttcctgctcagcaggatgatgggggaggacgcgttgtgtctctatcatggcaatcagaagaaggagaagatattctgtcatcagggaaggggtgaaaccgagcatgggagagaataatatcagaggcagttgcctgcttcatagatagttacagaaaaacatctgaactgacatggtgcttacatgagattgccacagttgatacagctcagaatacagccttttgaaaagtctaagcttagaagcagtcgagaacacaaaaggaaagaaaggagagtgaggtacttggactgagcgaggtggaaggtaatagaatcccaaataattgggttaaccaaatacgcaatgaattttcctcacatacaagcaatcagagatagaccatctttttattattttttattttattttttgagatggagtctcgctctctcacctaggctggagcgcagtggcatgatctcgggttactgcaacctccacctcccaggttcaagcgattctctgcctcagcttcctgagtagctgggactacaggcacatgccaccacacctgattaatttttgtatttttagtagagatggggtttcaccatgttggccaggctggtctcgaactcctgacctcaagtcatccaccctcctcagcctcccaaagtgctgagattacaggcgtgagccaccaagcccagccagatagaccatctattatggctagtgtcattgccctcaaatatcaaggacccaggcttctagagtagggtgttccaacctcagcactattgacattcggaccagatgattctttgttgcagcagctgccctgtgcactgtaggatacatgcctgccctctacccactcaatgccagcagcacccaccacctacgctgtaaaaatcagaaagtctccagacattcccaaatgtcccctgagagggcaaaatcagcccttgttgagaaattactattctatatccctgctctgccatcagtaacatatggcttttatctttagattcacaaaagaaaagtaggcaggtgagtttgttggcagtcacagctctacagaagccttgtggtagctttcagctcacatctgtctcgtggccctgagcttggccacgtgactaaccctttgttacttgcacagaagtcggggaggagaatatttttatctggacatattgaatccctagccaacattagggttctgaggaggacagaatgggtttggggcaggtgactggcaggctctacaagaagacattagagaagaaaggagtaaaacagatatttcactgacctcaatgataaggcatttcatggatacaaaaggagggcccccctgcggtacaaagcatggccattctagcactgcccccctgccttctaggagcacagagtgtctgtgagcactgcagcagcccattcccaaagaaactgggctcctgttcatattccacgaggcaagtcttagaccataggtgtgcctgcagtcactccaaattgcatgtccctgcagtgtgaggccaacattaagtcttgagatggagcagcgttaattggccattgcttaagagtctcttcattttctcatctcatgggttttaaatattttttaatgttttataggtcctttaggacaccacaccttttcatttattttagtatattttggttaaaaaaattctgtgatgtttaaaattagggaataataaaaaaattccctatgaaacctcacccttagcttgaagaagtaacaagtcatagtgaatctctgtttcctctatatccccaccacccaccaacccccccagatcccatacactatatcattccatctacagatatttcagtatgtgtgtgggggtcctaaagacaaccaggtttcatgagtcactgggaggactcataagagtcagcatttagacacaattacagctgtgagttattatcgtgaaaggatacagaacaaaattatcaaaaggaaaaggcacatggggtgacatccagaggaaaccaggcacaaacatctaagggccctctctaaacacaatacatgcttagtgcccctggcgagttgtatagcatgggcatgggcggactgtcatctaccagagaacctcactagagactcagttcccgtgggttttataggtggctcgtcacactacattctagactttcagaaggaaagcaggtgaccagccaaagccacagggaacaaaatagtttaggcacagaaagccactttgatcagtgatcagtttgaagaaaaatgtccaggaattattatagatagtggtgatggttgcacagctgtgtgaccattctaaaaaacattgaattgcacactgtaaaatagttaaaatgatgacttttgttatgggaattttgtctaagagaaatacatcccagttggcaccatttctataaaaaggaatagtgagagataaagcttataatatggtttcgctgtgtcactacccaaatctcattttgaatggtaattcccacaatttccatgtgttgtggcaggaacctggtgggaggtgactgaattatgggggcggatctttcctgcgttgttctcctgatagcgaatgagtctcatgagatctgatggttttaaaaaggggagtttccttgcaccagttctgttctcttgaccgctgccatatgagacatgccttttaccttccaccaggattgtgaggcctccccagccacgtggaactgtaagtccaataaacctctttcttttgtcaactgcgcagtcttgggtatgtctttatcagcagcctgaaaatggactaatacagtaaattggtaccagtagagtggggcactgctgaaaagatccctgaaaatgtggaaatgactttggaactgggtaacaggcagaggttggaacagtttggagagctcagaagaaggaaaatgtgggaaagtttggaacttcctagagacttgttgaatgttgaatggcttttcccaaaatgctgatagtgctatggacaatgaaatccaggctgaggtggtctcagacagagatgagaaactagttgggaactgcagcaaagatgacttttgttatgttttagcaatgagactggtggcattttgcccctgccctagagatttgtggaactttgaacttgagagagatgatttaggttatctgcttgaagagatttctaagtagcaaggcattcaagaggtgacctgggtgctattaaaggcattcagttttataagggaagcagagcatgaaagtttggacaatttgcagtctgacaacatgatagaaaaaaaaaatcccattttctgaggtgaaattcaagccagctgcagacatttgcataagtaatgaggagtaaaatgttaattcccaagatcctggggaaaaatgtctccaggccatgtcagagtcatcacagcagcccctctcatcacagacctggaagcctaggaggacaaagtggtttggtggactgggcccagggttcatgtgctgtgtgcagcctagggacttggtgccctgtgtcccagtgactccagctgtggctgaaatggcccaagttagagtttgggctgtagcttcagagggtgcaagccccaagtcttggctgcttccacatggtattgagcctgtgggtgcacagaagtcaagaattggggtttgggaacctctgcctagatttcagaagatgtatggaaacacctggatgcccaggcagaagtttgctgcaggggtggggccctcatggagaacctctgctagggcagtgtggaaggaaaatgtggggttggagccccgacacagaatccctactggggcactgcctagcggagctataagaagagggccactgttctccagaccccagaatggtagatcccttgaaagcttgcaccacacatgtttgaaaagctacagacactcaaggccagtccatgaaagcagcctgaagggaggctgtcccctgcagagccacaggagtggagctgcccaaaaccataagaacccacctcttgcatcaacatgaccgaaatgtgagacatggagtcaaaaaagatcattttggagctttaagattttactgccctgctagattttggacttgcatgggtcctgtagccccttggttttggccaatttctcacatttggaatggccgtatttacccaatgcctgtacccccattgtatttaggaagtaactaacttgcttttgattttacacgctaatagacagaagggacttgccttgtctcatatgagacattggactgtggactttggagttaatgctgaaatgagttaagactttgggggactgctgggaaggcatgattggttttgaaatgtgagcacatgagatttgggaggggctaggggtggaatgatatgatttggctctgtccccacccaaatctcatcttgaattgtaattcccacaatccccatgtgtcatgggaggaacttagtgggaggtgatgaattatgggggtgggtctttcctgcgctgttctagtgatagcaaataagtctcatgggatctgagggttttaaaaaggggagtttccctgcaccagctctcttctcttgtctgctgccatgtgagacgtgcctttcaccttctgctgtgactgtgaggcctccccagccacatggaactgtaagtccaataaaccacctactttttaaaattgcccagtctcgagtatgtctttatcagcagtgtgaaaatggactaatacaacttatgagttgaatttggggtgaatttacattatattgaatgtcaggtaaggagactgaactctattttgtagttcgtaggaaggccagcctagggagttttcatggagggaaaagttaatggagactgctctgttgacaggatgtaaatagcagctgggaaggaaaatgacaacatgcaaaagagtcttttaaagactctagtgaaaatgtttcacatgcctgtgactcagttctgatgatggctgtgatgctcatcatcaaaaaacttgaacttgtcttttaaggtctctatctggtcaacagcagaataacggctaccatggacggttctatgtgtggtcctggatttcctaagaattctcctgatccttgcttcctctgtttctgctctagaagggaaaattggagatcagagagttgaagctacaccttgcaatacagtacagcctttatttacactattaaaaccccttggccaaatggacaaagtgacaggcttagccctttgtatgtttgtccttatatttgcttattcaacaagtattcacagagcatcttcacttgccaggccaggtgattcataaggaaacagagcctcaaggtaaaatccaaagagcatgtggtttgaagccaatagacaggtactccagtcccaggttccatgcttactacccaattgattgctgcctctcagccattcctttcttcacctacacgatgtacctgaccaggcttttcttatgtaactactggaggcaaggtgggctctcttgactgaaagcactctgggaacacacaattttggccaccataaatgacattaaagaatacaacttttgctttagaatctgcgattattgtttgactttagctaagtaagcattttgtcaaatctaacagcaaaagcttctcagtaaaggagcatttcaagaaacctgtgaccctcatagccacaacatttaagatcagcatcaaatattttgtgtaaaggttccacagatgtttgattttttggggtaaggaaactgaggcttacagatgtttttgagacttaaagaattgacacgtcagtctctaaatgaaaaactgcgattaaaacccaatgcttctgcatcaggaggactagctaatggttgctgggcttaatatctgggtaatgggttgatctgtgcagcaaatcaccatggcacatgtttacccatgtaacaaagctgcacatcctgcacatgtaccctgaaacttaaaagttgatgaaaaaaaaccaatgttcctgatttatagataagtaataaaaacaacaaagtatccttttagctgaatgatccctgcttgctaacattgatgaatttagaaatgtgtcttcagttgacctctactcactattatttttaattagttttcttaacagccttaatagtgtttagagcattttatgaaacagtgccctctagtggctaaggatacacttttaaattgcaataacaggtgctatttttagctagctggagaattgatggcgaggctggcatttaaagagatgtattatcttgtggcagatgtgtatattgtacatgtgtagcaaataagcatgaagacagttactgtctggcttgttaactaggtgtatgatttcttgatcaccgacctattaaatcacttattaatatataatcttatcgtgagtgtaaatttagctgcctgtcatttataataacattagcgatgtgacgtatgatcatttgagcaagagcactgctttctgccaaagccaagagcctcaataattatttttaaactgtagttaggtatgatttaaaagagatgtgagtacaagaatagataactcaaggatcaacgtatgggacctaatttttatgaaaaattactcctgtctcattcttcttttcttgtccaacagatcattacaacccaaaagctcaataccatattcctcaaaatgcaaattaaatactgcctctcaaaatagcctttcttaactaaaaatatccaagtttatcttttacaaatttaggcagtttttggttaaaaagacaaaacggtaatggaaaatatacagtatcagggtgttttttttttttgctgtggaatgctattaaaattacatgtttttgaaacttgtcgtttgtggttttaaatcctcaatcatgcattacctaatatatgcatatctgggtccatgcagtcaaagttaccatgttgaaagagattttgcagtttaggaaagtaaggatcataaatgtttagtgaattaagctgacaaaaactattccattttgtaattgcagaatcagaactaggagactgtctcttgactacctggaatgtatgatttacacttgtgttctggacagcagcatctggaaagtctaaatactgtagtctcttcagagacttccaactcagattcctgggattccagagctggcaggatcccctgtagtctggcacagacctctcagcccatactaatccttggcttaattttattctgaaagactttttaaaataaactttttatgttttagaatagatttacatatatagcaaagttgcaaaggtagtacagaaagtttccacatgccccaaacccattttcccctattattatcatcttatatattatgcaacgtttgacacaatgaattaatagtattgatataatgcatcactgttagacaaaatttatgcttaattcagattttcttagctttcacctaatgtcccctttatctcccaaggatcccatccgggacaccgcagtgcatctctttcagttcctcttgctgtgacagcttcgcagaagttcctgtttcttgatttgggtgaccttgacaaaagggtacttgaggaacatgggtcacgtcttttatagaatattcttcaattgcatcatttctgttttgttttgtttcattttccctcctaagtagactgggtttatagggctttgggaggaagactacagaagtaaaatgcctttctcatcacatatctaaggaacaggctatcaacatgatttatggccattggtgttgaccttgatcacctggctaaagtcgtacttgtcattttctctactgtaactacatttttttacccctctttctatactgtgctctttggaaggaagtcactatgcatagccctcacttggagtggaaggcaatgctctttcttcttgagagcagggtatctgtagaaattacctggaattcttccatatggaagatttgtctactctcccccatttatttatatttatttatctataaattatgtatttattatttatttattgaatcatttattaatatcagtatagacttagagatacttatttaagactgttggaagtcattgtttaattgccaagatttgaaaaagttgattttgacaatgtttgcaatctcattgcttttctggaagagatttttggagatcttaactctgctatttggatgtagctcctttttttgtaggattttacacacagttttttttttctcagtttttgttgtgttcagaatggcctgaactctgacacagttgatattggatgatattcttatccctttcaatgctctcaagaattttcagtaaagattttttaagtttcacaattttttgtgctaccaggagaaatgtgtctttagagggtgactattgaatatatagaaacccacattcctgagatttttttgtgtttaatggtatatttcataataatacaactatcttaaaaagaatcacattggcatatttactctgcattattcaaatggctaatgctttgagaaggaacatcctctttataataaaatgagtgctgtcttgtttggcttatttagtatcaaattaatgtgatactcagtgtttcattaagttcctccaaataaccaattttaaagcaacttcttcattctttcatggatataatgctaaaggcgtaaaaagatgatgacccatattatctgaaagagaaaaacatgatttctcctttctctcttaaaattaagatctatatttatgatagcaaaagtcaggtgcttctctccccaccttttagaagctgcttagtgtgatcaggggataactacagagaagcgctatcaaacatttctttctgcactttcagttaggaggatgatgaatgcatacatacacattttccctttctagtagcaatagattaacactgttgggaataattcccctagaaagttttccgagagcctggaaatttcacatcatacttttctagccctgggtcactgtgagtttgccaaagcctccagcagatagataaattggtttccaagtgaacaaagtatattagtcaatctcctgaggcattttttctttgatggccattgagtgtgttaagcagcaactgtatgcccttcataataaaaagcactttaagttgagtgatggaaggctcttgatacttgtggaatgacagagaagttttgaagaaatgaacattagtgcaagtagacaatatttagaaagcataatcaaataaagagttttaagaaaccataatttttttttttactttaagttctgggataaatgtgcagaatgtgcatgtttgttacataggtttacatgtgccatagtggtttgctgcacccatcaacccgtcatctatgttttaagccctgcatgcattaggcatttgtcctaatgctctccctccccttgctccccgccctgatatgccccagtaagaaaccataataagttttaagtcaaagtgagatggaaaatacagagaagggttagtctttgaagactttggagaggtgatttgaaaatcagatgttaaaggaatgcatgggcataaattagcaggacattccaaaccagggctttgatgtgaacataagtcagttatgtgaggaagcagcaggcaagagcaggactggagagggtttgatgtcatctcaccaatcatccacccaataaagaaatctctcagcaacccctggcctgtggtcagccaatctgtgtctgaatgtatcgatcaagtaataatagttcagtgctcttagtgaggaagccagtgatgattgttacatggctctataatattaagataaaatttgtccccagaatgttctatgcttgggttcaattattccttttggagcaactcagaatcaatctaatattttggggaagtgacagtttttcagatcttggaggaagaacttattattaatctctctcccccattcaacttaattgaaagagtctccgattagaaatttgagaaaagatgttctagccccaactctgctatgtattatttgctttgtaagcaaagaacagttaaactgtctcaactatatatagcgtctatttccctctgttccttccctatccagggcttggctctatgaaaagcaactcgaactcttgccttccagcttgggatactgctccaagatagcccccctttagtgaactcctgtctcctatgcagttccatcttgttatcttatacctggattctccatctctgcccagacactacactaatttggatagttttatttctttctcacgttgcaattaatgaggatgagcctggaggtgggggttcctccatggagtccttcagggactggggttccctccagctggtgactgtggtatctataagggctcaaattcctccatcggatactctgtatcttgatggcagactcaagaagagaatggtgaggctgtcacaggaagttttcaggggctgggcatgaaagaggtatgcatctcttctgcatatatttcccattaattcacagtcagtcacttgaccccatctaactgccagagagcaggggaaatgtagcctagttgagtgcctaggaggaaaaagaccaaatgtagaaccagtgcatgtcacttctgcctccacttgtgctagaattcaggcacacagtccccaactaacctcagaggaatttggaaaatgtagtctggttgaaggctaagaaagaaaaggcactaattagactttccaagcttatcagctttagagaagagaaaatagcatagattttctatgttatggagtaaagttgtataatataataatgcatgtgaaaatgcttataatctggtaatgtggcataaaaatgaatgttaatatctttttttacaaataattctggacaattagacagccatgtgcaaaataatgaagttggacccttacctcacaccatagataaaaattaactcaaaatggatcaaaaacctaaatgtaagagctaaaactaaataatttttaggagaaaacagagggataaagctttataactttggatttggcaagattcttagatatagtacaaaaagcaaaaacaacaaaagaaaaaatagataaactgaagtttatcaaaattaaaagcttttgtgtttcaaaggataccatgaagaaagggaaaaggcaatctatcaagtgggagaaaatatttacaaataatttacctgttgaggaacttatatccagactatataagaatgcttaaacccaataataaaaagacaattattccaatttaaaaatgggcacaaaatctgaggagacatatctccaagaaagatttacaaatagcaatatgtacatgaaaagatatttgacgtcatcgttcagcaggaaaatgcaaatcaaaagcacaatgagacactactcccctcttcctagaatggctacagtaaaaagtcagataacaagtgttggtgagaatttggaaaaaacagaaccttcacgtcctgctggtggtaatggaaaatggtgtaaccactttggaaaatagctgggcattttcccagacaaataaacatagagttatcctttgacccaacaatttcattcccagctatatacccaagaaaaatgaaaacatataaccatatacaactaattacactaatgtttgtaataatattcataatagccaaaaagtgcaaacaacccaaatgtacatttgtgtaatggaacattatttggccataaaaagcaataaaatactgattcctgctacatgctacgtactgattaagtttgaaaactgtaagacagtcacaaatgactacaatatacatgattccttttatatgaactattcagagcagagaactctatacagacagaaaatgggatagtggttgcttagaatgggggtgaggggcatgggggcaaagaaagtgatagatcaaagttaagggattcctttttgagattctgagaatattctaaaattaattatgatggtgggtgcacatgtctgtgaatacgttaaagaccattaaattgtgcactttaaattgatgaattgtatggtgcgaattctatctcaatgaagctgttaaaaatgaaaggtaatatatgcattattgttaataagatactggcctacccagatgaaagactgtgcaacactcatggcaggtccttagaaaccaagttctgaccactcaaccatgagaaatactaatgaggaagaaatagaacaagcatctccagcaaccagtgtactagtctggacagctttctgatgatcttgactttaagaaaaatgtatatacaaatggagctaacctcagaacttaaaaatcatgccaagatgaccaagatccaagatgatgtaaagcttgtaagaagtgtaaagggaccaggcacggtggctcatgcctgtaatcccagcaccttgggaggctgaggcaggtggatcatgaggtcaggagttcaagaccagcctggccaacatagtgaaaccccatctctattaaaaatacaaaaaattagccgggtgtgatagcaggtgcctgtaatcccagcgacttgggaggatgaagcaggagaatcgcttgaacctgggaggtggaggttacaatgagctgagatcacgccattgcactccagcccaggtgacagcccaggtgtctcaaaaaaaaaaaaaatagtgtaaagggcattgaacagaactgccaggtaatattggagcaagtaagagggtaaggaggttgaacaactctgaatacactaaaaaccactaaattatatacctaactgggtgaatttatttgtatgtgaattatatcttgataaagcatgtgcttgctcttgctctcactctcgtgctctctctctctctctctatgactctcttacacatacacacacacatgcacacacacacacacacacacacacacacacacacagagagagagagagcaaggaaaagatagaccctggcgtggaggaggtatgcaggataaccatgcagtaaatattcttgcatgttctccagtaaggaatgtatttttcaaaattgaaaaggaaaattcgatatcactttcttaggaagggagggaagattgttcaggaaatagtgagaacaccgagctgctcagggagattcacctcaatctaaagtaaatttgagatgggataacataaaaataactaggtttaaggtactaggacaaaacatctagcatgcattatctcttttaattgctcagtaacccagtgaagtaggtaatatcattatcacccattcagagaggttaagtaacttattcttagtcatgcctgtagacaggatgaacaccagtttgaaaaaccctctctctggctctgggggcaaggtgaaagcccacgccatgtgtttgagaattcagcgcaggtaaagaaatgtttttttgcattggtgatattttatttagtagtaacactttattcctaaggcgtactagttgacttgtcaatgaaattacagaaccattgtaaataatctgtagaaatttgcaagcaaatgagaaagcagctgaaagactgggaaaaagagatgattgttttagttgtcaaaaaaggtaaatctataggactagttcataactggcaaaattctagagccatttaataaatacaagtatgtcctgtaaagcggtttgcatcctggtaacacctaattgtaagccatacaaatactccattttcctaacttatttctagagaatcaattatgatcttaccatagtgttatcttaacagcttttatactttcaaatgaaatggatttattcaaacattagttggtgatatactttttatcatgctgtaaatgatcctaatagaatttgttaaaacatttaagttacgagtgaagcacagttttctagatgtgtgctggactaacatttgccataaactatcacataatcagttccttgattctttatggacctgaagcctacttacataaaattggtctagtaactaatgataaagattaaataaaagtcattgaggtcattgacagaaggctatgttttcctctaaaatcatggcactcaattcataaacattattcatttttcttctaacttgtatatacttttagatgtaattgtgtttcaattttgattgcccagctaatcggaaaagctttaaacctcttaaacagtttctttataaaagcataatgacgtatataatggctttcagataatcctgtcacagaaatgattatttttctctattcctggtgaaccaaagtgcccccatgtgcttctacgtgtaatgttatataaagcactttgaagcacgctgtattatttttcatgacagtatcattgataattctaatggtaatttttccttcacacttggtagcttccaggcataatgacacatcactaaagctttgactgttaaagccctttgctcatgggtgaagaaaagagaatggcaagttaaaaataatgacttaatcctcatttacattgcaatgagttattctcatttgtggaagagggatgtcttcgatggggaggataatgaaggcgatgagaactatcagaccttttgtgcccgatcaataggtcccataaataaaatctcaaatcacacactacaaagtggaaatcatgtgtaatgggaagggagtgaaatcatcatcttagggatggcaagttcttactgagaaggatgacttcatgctggacctcttgtggtttccagagctgtagatgaataaattttcatcccttgattgataataaattttttgaggacaaaaatagttctagattgagaattcagtcattagactagactcaaggggacatactctagggacaactgtgggagaccatagactagacgatggctttcttacctgcaggaacaggaaaaaccatcttcaattttgtggtctgggagggactgtgcctaagcaatgagaataaaaatacaatctattctattgaaaaggtctttagagcatccttccagtaatctaaaagtgtgacaccccaaatacactagttctttcattattttcttcttccttctctttatcctgaagcccttaagtctactcaattatagaatttcttcataaatgacttatagggccatttttgctgggaatggaatgattttccatatcttctattccatcctacctaattttagtcaacctgaaaccactgctttttgtgaataacgaatgtccaacagaactcccaccaacctcacagtcccagacatctgcattactgtgggtagtcactcaaatgtagctagaggaggctttaccagaaaagctaattgccccaaactttcctcttggaattagagttgagtttttgttggtttgttttttaatgtgcccaattaatcttttattggtgtgggacaaatgttgagactaacaagaagattttggataagtggataacaatctcgcaccctacatccctccttcatgggggaatgtaagtgtggattgacccaaagcaggaactctaggggtgaagcaaggactcagctctgccttttcatcagctctgatcatccattagagatgtccaccctgggaaacatgggaaaattttcacaccacccaaagccctgcactgattccaccacaagctcccagtggggtctgggccttgtatgtcaacacagcaagatagctttgtatgaggacagtttccttcccaccagacgttagagtcatcctaggaacaactgtccaaccctgggcacgtgccacccagcagcacttctgaatatgccactgaggggagagatgaaataaacacctactcaaacccatacatctttcttaaattagccacaactaatttctttcatgctgatttttatttctaaagctgtgatttccaaagccataaactttgggtctgaatgaaattaagaagggttagagggctgggcacggtggcttatgcctgtaatcctatcactttgggaggccgaggtagtggattacctgaggtcaggagttcaaggccagcctgatcaacatggtgaaaccctgtctctactaaaattccaaaacaattaggcaggcatggtggtgggtacctgtaatcctagctgcttgggaggctgaggcaggaaaatcccttgaacccgggaggcagaggttgtggtgagccaagatagcaccactgcactccagtctggccaacagagcaagactccctctcaaaaagaaaaaaataaatgggttagaaatacagctagacgctaattcagaccctctccttctcatactttccatcaaacccatttttctttctcaggaattcttttttttcaattgctgttaaatatataatataaaatccaccattttaaccatgtaaaagtatatactttagtggtacattcacatcgctatgcacccatctcctccatccatctccagatccttcctactttccaaactgaaactctgtccctattaaaactaactccccattcccccagcccctgcacccaccattctacttcctgtctctgtgaatttgactaccctggggacctcatgtcagtggaatcacgcagtatttgtccttttgtgactggcttatttcacttatcataatgtcttacgggttcatccatgttgtagcctgtgacagaacttccttctcttttaaagctggatgatattccattatatagacagacaacattttgtttacccatttatctgtcaatagaatcttggatggcgcctactttttggccattgtaaatgatgctgctatgcacatgagtgtacaaatatctgttcgagtctctgttttcacttcttttaagtctatgcctagcagtggaattgctggatcaagtggtaattctatgtttaatcttgaggaactgtcataacatttataagaagctcttaatatttccagaaaccatcccaaatagtggatgagccaagaagacaaagtcatttcaatgccattttgacactcaagaaattaggccttaaaatgcttaatgtacaaaagaacaagcaatatacacttgtctctcttcaatggaaatagagttatttctgtgtgagagtctgttactacattctgtggaagtggctggagagtttacctggcttacaaagtctgttttgaatggcctgtcataaaatttgcatttggggactctggcgtggcacttcaaaaggtcagccaccattctctggaataccatgtgattggagaagcagattgtttccttcctcatggaataattgtcctgtcctccctggtgtgctttctacaacaatcagggtccaccgtgcatgagaggccagaggacctagttctgggccatggactagattcctgacattgggcatttactgtttctgagttccttcctaccttccttccttccttccttcctacttttttcccttccccttccttcctgtctcccaggctggagtgcagtggtgcgctctcggctcactgcaacctctgtctcctgggttcaagcacttctcctccctcagcctcctgagtagctgggactacaggcacgtgctaccatgcttggctaattttttgtgtttttggtaaagacagggtgtttcaccgtgttagccaggatggtctcgaaatcctgacctgatccgccctcgtcggcctcccaaagtgctgggattacagacgtgagctattgcgcctggcctgtttctttatgagtaaaatgaataagcttgcatgtgaagacaaccccaagtctcttccagctctaagttcccacagtgcacggaggcccagatgatcactgcaggaataggaaaaaccatcatcaattttgttgtgtgggagtgtctgtgcctaaacagtgagaacgaaaatacaatctattcattgaaaaggtcttcagagctcagtaaattttgccaaattcgatccatggtatacattacacctactaccttttctgatttcttttctctctttttcctacaaataatcactcttcctcaggtctggggatagtccagtgaacttgacagagtcttcaaggtctttcctggggccagactcttgcggcaccagctctgtttaatgtaacttcacaaaactgctccatagcctgacttcctggaagggtgttttcctgctttcccagatgaccagaaggacttcctcaatacctactccgaactctgctttttttttttttggtccagacagaaacataaaaagagaggtgcagcattccaagatgcagggagcgcaaaggactgggaatgtcaggagaccatgcttagccacgcaggaaggcgctgaggaaccgtgctactgaaaggagaatgagagctgagccccaggggaggcatctgcagtctcccaggagaaatttctcacatgcactgactcaagaaaatgtgacgtataatcatgaaagacatatattatacacaccatggctgattcctacgaaagaggaaaacaaccaggcaaatctatctgggaagcacaattataatatttattcacttgagtaggactctatcctctgatttaacacatggagtgaggacataagactcaggactgggatgagaaatgtaaggtgcatgaatttcaaaaataataaaatgaaaatatttatttgcttatggttcaattacgtggaatagaagcataagcagaaatcaaatggtcaaacttacaaaatctgctcttctttctgaacagtgatcaatggcctcactgaaaggactcagggcttggatgtctctgtggggtagtttattctagcacttgtgtgtgttttgccttggcaacacggaccaaggcaccagaatagcacacagcagctgaatgccatctcgaattttctgatttcactcccaggcttccagtcttttctgttatctttttttattttgaaatcctcattatgtgtttgctatatgaaagcacaccaaaatgtagcatgacacagtccctcccatgaaagcagaatgacacatggggaaggaaaaacatgatccaagggctgggagatggtgaagaaagtgctgagtgtggaccaaggtcatcacttgcctctgtagctcccctggcaggactggacatgtaggaggcacccccacagtcagtatttatttggtgttctaggttggaataatagtgtgattccattcaagggaaaggaacaaaatcagatcccagttgtaacactcattgcagcattttccttgagtctggggcaggtgtgtccagcgattctgcttggagaaggagaagatcctacagatgagcttctccacagggtgagagttgagcacccagcacggtgtctgcacagaggatgacaaaaatcttgaatgaatgaatggagttgaataagcaaacctaggacagggtgtggaaggtgaactcatggttcataaagtcagatactttggcattagtgaggtaggcctgtgtatgtgagtattcacacgcagttgtttctgtacttgtatgagagttactaatgttgatctagttgacattgtttagttcctagcataaataaagtatcatgacattgtttaagggaagaaaatttactttgtaattctgtggtgttgaaagtagggaaagaaatatgttgccttttaaatacacagcagcgctctcatggagatcacatggaaatgacagcggtgttgtgtccggaaagcaaaagcaaaacaaaaacgagaaaaaatgaaaccaacagaacttgggcacttaagaaatccatttcctaatggagtaaacagatatcgcactgcaagttacaattttcaacatcgtttaccctacacctccaccattcggagaggcagctctaataaatgagatgcagtgatgacctttaccggctccaccgatagctataaattgagctgaacattcccatcagctaacaggacagaactcattactgactgaagattgctacgatgcctttgactgagatgtgtaccattaaaatgaatgctccttcactcgtaaaaacaatgtcttgtaccgcagaagacctgatatgccattcattgatttttgtggatgactacaagaacaacccgtaaagattagctgagtcttactgtgtgttagttaaattatgattcagatcaatttgttcttttttgagagagttgattttttgtttcttaaattagaacctttgtcgatggcatgcatggaatataattgtcagatttacagtcctgatgattcaagcttagataaacacttgttccaaatacattaaagtaaaacttatatccattaaactaagtcaggattttgaatttttaaagctttgggtacatagaaaaaatttggttttgccgatttttttggcaaaatgactctgactttgagaacaaaccagtgtccatgcccaggtgacagcacttgccctgctgtgattattaaagcagccccttgcactgccaagtgtcctagtccagatgatgaattgcacagtcttattggaagtatgtgaaatgggaggactgtagccatacttgatctctaggatacacttttatcaggccctacaggtaaagtattcccataggccttgtggattttcacaggaaggcctaagttactcagatgtctgggagttgtccctggttggtttctgctaataacattagtagtcctgacgcttcatacttagcaggacctaataggtgaacccagatatggttctaatgtcatttaagttattaattgacattattaatatccccattttttttcagatgggagtatcaaggcacagaaaagccatataacctgtctgaggttccacagttaatagctagtaagcatgggaatttcctaggactccaggttagggaactacatcagacacgggttctcatttcaccaggaaacaaatgcgaggacattcttacttccacttactacaatatattaatgactagtgtgtgatgatacctccacccactcggagcttagagtgataacccggttatcctgcagctttcagatgatgggttctacctctctaattgactagactttctctaataatactggcaaagtctttatgggtcaaagtcagaagggaaagagtctctagtcagagccagagtcataagacacagtgaatgtatactaatgatgccacttggtaaacttccagcatgttatgctggaggaggctgggaggcagtctgtccctctgtccctctgtccttggtggcacagacagccccctggagccagccaaattcagactcacattctgcctaaggcagagggacacaggcagacacacgctaccaggagacgtctgcctttgacatcccacgtttgtgacacatgccagatcttctcagaaagaaacagtgcaccacagccactgtgccatcaggcactttgacactcacagacataaatgggcaagtcggaaggagtagatgattccctctaagaggacctgcctacttttcctgggagagtgaagaaacctctaatcattggtttctctgtttttccaacccaatgagtagacagaattgttccatgtaatgatttttcttctctctgtataagacactggccttcctgctgtttgcattttggattattttgtttgcttttaagtcagaaggacaagagttgtgtatagacaagctttatcatagattctacctaaaattcttctggaatatgattcagttttttcctttgtaaataaaatcataggtgaatgtgtggtcaaaaggtgtagttggttttcccctttcagagatctgagtgccgctgggggaggtggcatctcatatttataaaacatgttatttattttcttactttcaaaatgctaaacatagctgatctcaattaatcagcacagtaaccctttcagaaaaataaggtattctattactgaaaatgaaagactgcaaggtaaagtaactgctctcaaaaaacgctgcaatgggattagaaccaaattctcctgattccaaagccagaagttacagtcagagtatgattgtatttctttattaagattaaagtcagctctcagcagcagaaagattaaaataatactagtttaagaaagatggaaatttacttgtctctcaaatttatttattttccacatataagtccagaggtggaatctacactgtattttgcttttatcttccattttcatcttttgcttttatcttccaagatcacctaaaggaacaaaatggctgctctagctccagccatcataaaagccttcctgctagcagatatgaaagaggagaggggactatcatgctctatccctttcaggactctgctttagaggttgcactgcatacttctggcatagccagtctgtggcaaagcctaaaatagaggccaaatttccagatttttggaccaagctctttccaacaatctgtcccttacgcctggagctttttgtcaccgttgtgttgatgtaatctttggtcaagtttctgtctctcagcctatccattagtctttgctagtaggaggtgatttttctcagggatgcatagataaggtaaggtggaggcttggctccattggaaatgctgaaatgaatttactgcaaaactagtgttttctatgggagtgggatggggcaggaaaatctattgcatctccaccagccagaattcacttgcgtctagtaagacctcctcacatttccatcagtgtctacaacttacagagtcacaaaaagctcggagacaataggaacagacatcaaaattatcagtaacgcaaaatataagtgcccatataatgcctaatataagtagcatgtaccggacaatgcctcgtattctactgaagaaatagccagtgatcttctggcggcccatttcaaagtcttaaatttttttgacaccttcagtaatacttgttattgatttgctctaagtgaggttttttaaataatagaatcatcataatccctttagagatccttcaaaaaatcttagatttatataacagctaatcataagaatccttaacaatgtgtatatgcgaagtccttttgttcgttatcaggaaagggcttggctgataacacatttctgaggatattcattcctggataaatttttaaggatttttattctttgctgatctttatttcaccttcacccctctcaacatttgaaagcctacttaactctatattttcttttatgttaggttcaagtgaaaaaataatttgcaaaaacaaatcctaattctacaaataaattgtttttttttttttccttaaccatgtagcaggtggttgacaatattaaatacagaaagagggccttcgttgtttcagtggggtttcagtgtatcaagctgtttaaaagtctaaacaggactctgttaaggcacataaaaattgaatagaaaataatggaaatgtaaaagattttaaaagctatttgggcaatgcattaatcaaaggcaaattgggcagtctcagatcttatgattaaaaattaagtgaaattgaaagccactaaagtcatctttgaaatgtagctacttcccaaataatttccaagctgtgattatttttttgaaagtacgaaagtacttatcaatgtcattactgacgttgtaaaaatagatattgtggtatcattttaccgtagtttgaagtccacagaatgtaataaccctcctctcagtctatccacacacgcttacccatttcagccccagacaattctccacctttgtttccaaggtttagggtttctaaagcaaatgcctcctaataacctcagacttacaaaatacagtacctggttgcattcttgaaagggggaagaaaaatattacgtggtctttctaactcttttttttttctttgagacggagtcttgctctgtcccgcaggctggagtgcagtggcgcgatctcggctactgcaagctccacctcccgggttcacgccactctcctgtttcagcttcccgggtagctgggactacaggcacctgccaccacgcccggctaatttttgttgttgttgttgtatgtttagtagagacggggtttcaccgcgttagccaggatgatctcaatctcctgatctcatgatccgcccgcctgggcctcccaaaatgctaggattacaagcgtgagccaccacgcctggcctcattcttattctcaagatcctgcaggaaaatcaggtgtagtgaacctcccagtcaggttatcccgccacgtatgttaaagttgccagcgtaagttggaatcaagaggcctgcgtgaggcccttgagccagagggagctcattaaccagccagcaattctaatgttcacatctcacttagggtcttggagaagctgggaaatctccaggtctcgggagcacgtctcacaaatgtcaaggctgtaccaccttggttaagcgcttactggcagggccgctgaatgctgtttgtatttagaatggaaagaaatattactagaaaacttgctcttttgaaagaaacctttgtacctctttggagcccacattgccttcctctgacaatttttgtgaggtaaaccagaaagcagaaaacccagacacgagaaaaaaaaattggaactctgtctcctccctccaggcctaatcctacgtactaaactgcagccccgctgtagagcttcccagcgtctgctcaggagccccctgaactgtcttcacctgtacaattagtgggtgttatgggaacgtgcacctctggcttcccaccttcggtatctcccacttcctgtacttgttttacctaaacacgagaatagttgctcacagtttagtctttctcaattctaccctcacccaacgttcccccaaaacccacctctggggcggggatcgccttcctgatcatccagggagaagcatctaggctgttttgagtcactgctcctcactgaccgagtcattcccaagtggtgcctgcactgtggacaagagctccaaccctattgtacgtttctagaaatcagggattatgtggtcttattttctgctccattttttatgaaatattttaaatattttcttgaaagggggaaggaagacattactgtggtctttctaactcgttcttttcttttttttgagacggagtcttaccctatactgtactctacagaaaagtagaaaacatatttcagtgaacacctatattaccagtacaaatgccaattaatttcaatgccttggccatttttgtgtcctccatcagttctttttttgctgaaaatatgtaaacataaattatactctcattttctttcatccctgaatactaaaacatgcatctccaaagtgtatcttcccatacatccacaggaacatcattgtatctgacaaaaacgaccataatccccaaatatcattacattcccaggccatattcaaattcccttattcagtctcaaaatattttctgtagcttttgttttctttaagcctggatcaaattaaaaatcataattgtacttgattatgtcttttacatttctcttaatggtagaatggctcctcttttttctgtgatatatgctatttcacaatacacctggattaggccagttgtattgtaggccctcctgcattccgcacttgactgattgctttcttgtgaggtggtttcacaggtttatctataatgtctacttgtcccatgattggtgattcgaaggggagattaatgggcaaaagaggtgaccaccaaatttctctattataaacatgtttttcccattgagaatggcgtattttctgtgggataatatcccattaacttttctccaaatgaggttagcatccatcattgatccttacctgcaccaagttttacgacaggggctacaaagcggtgatgttctgaattaatcacctcttctacacttacgagttgacagtcttctgaaaggtggaactctccttcataaacaggctatttggtgtacctgaagtaccaacaaagcaggcagctgaatccttgtctgtttttaattattagttttcagattaagaagttgatatcatagttatgttcagctatggaaaataaatagttttgttttctttaatgttttgtgagtatcactattgacttgtgctttctaaaatgtattcactgtgtcttcatcaccgatagcattattcttttggtgtttggattgtcctaactttgaccatggagagcccctccagagggttattctgtccttgtgtcagttatctaatgccacagagtgctgtgtaataaacaactaacaaccttccagaacacatagaataagtcatttttcacaaacctggctgttggcaggtggtggttagggaactccacgtatctcatggctgatgtgctcacatggccagacacccagctggatgttggctgatctggagtggcctcttcttggatgactggagcaactcggtttgttcttcatgcctttgatccttctcctgggccaggacactagaccaggcatgtttgtctcatggcaatagcagaacccaagagaaagcaagtccactgtgtaagagctttttaagcaccagcccgcttctacttactgatattccattgcccaattctagtcctgtgtctgagcctagagtcatgagaaaaggcccggaaaaattagatggaaaagggtggggtgaagaattggagccatttacaatctaccatggtcttattgatgtgtccttatcagtcacttgtctcccccactggtctttgctttctggccagtaagatattttagatttataatatactttgtgtgcctcagacctggaaacatccattttttcaaggatccctggctcattttggggagaatggtactcagagacaaaaatctgggtgtctaggataatcatgcttctagcccgttttcatggacaaaactagcaagtgtgtagttttgaacaataaagaaacattggttcctattgatatttctgatgcaaattcaacatcacagagttttaaattttaactgaatttccttttgtttgttaaagacagggtctcactctgttacccaagctggagtgcggtggcacaatcatagctcattgcagcctcaaactcctgagctcaagaaatccttccacttcagcctcttgagtatctgggactacaggcaaataccaccatacccagctaacttttaaattattttttttgaagagacggagtctggctatgttgcccatctaatttttcaggctctcaaactcctgggctcaagctattctcctaccttggcctcccaaagtgctgggatgataggcatgaaccactgcacctggtctgaatgtccatgattaaaaatgtgggtctcttttctcttgtacagaaaatcttagctcctaataacattaacggaattgtttattttcttggaatgatgtctgagagcacaatgctgtgattaacacggaatgctaccacagctaatatgcagtaactgtcatatgattatcagtttcattaaagtcagagaacgtggctaacacatggtccataccaaatatctagcagagcatcccgtacattgtaaatattttttaatgcataaaatgtctattggttttgttgttttgttgtgtttttttttttgagttttgcttcttgtacctatcatttctctttttggaaacacctaccttttctaagcatattctcatgcaaatgagttactgatctactttaagcagaatgcacataatttcttttacatttcctcaccgtctctatgtgtagtatttccttgatatgctaaagggctgtgtgcagttctcataatcccaaagaaaaggatgtagttatcatgttgcgtactttttaaaaatatcatgagttttaacaaaacctaaaaaccagaagaggctttggcatttccatggcattcaaactcctactttttaatccattgattctgatgacgattactgaggctcctgctacaatataagcctgcattcttttttaaggtcttgtgacatttgggttatgctggaatttgtttttaactatttaaagatttcctattttgtcccacagtggttgtcttctttatctttaagataatatctttaacactgaagacattattggcaagaggaaggtctggaggtctgctcaccacctttggtgttctcttccatagccatggcctgagaagggtgatttttccaggtgaaagataggctgtggtgtaaactaagacattccaaatgaaacataatcacttaatataacctcgtagatagtgctgtccaaaagaactttctacagtattggaaatattctatacccacagcatccaacacagtacccaccagctatatgtggttactgagaacttgaaatgtgtctagtataaatgaggagctaaatttttaatgttatttaattttaattaattttaatattaatggaaacatgtggctagaggctacatattagcagtacagttctagattataaatatggtccaactaaaatatttgcatttgactcatgtttcctgaaagaaactggcagtaggaattaatgtcagctttctaatcatttttgattcttcttataacttgccatacacaccttattgcttaagagccaaaggaaaaatcactcttcatgagaggcagtgtatctacatctggactgaagaccttcatttggctgctgtgagttcataggctcccagctcctgactttgcagcgaaaaatttcagaattggagcttgtggcccagtgattattggagaaacatggtgaaaacacaatcactaatagcctgcaactgaaatatcagattaattctataaacacaaattactgcagaagcccaaaagggatgaaatgaaagacaggtgcaacagacctttatttacgttatagctgcatgatgtttttaaaacttcttgaactgtaaatgttaatagaaaatgttaaagtagaaagaatagtaaataaacctccaaatctgtttgttttttaagtatcattttaagttcaagaacttatgcatagtcgatgagcttcaatcttttgcagttattagttttatcaatgctccaattgttttattcttggccagtgggagcctctccaagatggcttctgagtcattttgacatggtcctaataaactttgacctttgggctcagatattgcctatcacagacatggaattagccatttacagagagaatctgggtttcatttagtgggaaatggtatttctagactgcagtgtggatactggagattacagattaatattttatgaccataatattgatgttgactgtcttaagatatgtgtatgttgtatgctatttgttatcagaacatacataaatacaagtaaattatagatagaaataaaataaataatagaacactgtttctattgctagttatttaaaactaaaagaagatgataggagaaaaattaaatttactacattcattgtgtatactctttgtttcagaaattaaaatctattactatgtagggattctttgtgatatttatacaatcagggattaatgtactcttcaaaaccaaacagcatatataaattacacttagtaatgagatttgttagctcaattgttaatgaatctacagtaccataagatgccataacattatttaaatttttaacatacgcatggtcttcaaaagcctttttaaaaatgcattattgtcaagcaaaagtaaacaacatataaaatcagctgatctatgatactatgagtaaataactggcattttatctaattgttgagagagttagaaaaaataatttgttattgttatatcagtttgaaaaaaaaaacaaaaaaggaatcatcttcctagtcctagctaccaatgcaatttttttccatttctgtaatattttcagcttgaagaatcgcataggtacacaggaaaatgagatgagtggcatattttaaatgcaaagcactagatatattgcacatgaaaagtaactagcaattggtggtgctgtaagctttccttttggaaattttctcctaggaatctgacattgtatgtttcttagaactcccattgagcatggcttttcaactttatctccctatccatatagcgttaaaatgcactctacactcccctatgtaacatcttattgctttgcaattataaggataaaataacgataattgaatctcataaagaggcacaaaaggtataatttgacaaaaaagaaacaccatgcctacgcctccgtccttactccacctctgtcatggcctcctcattctagagcagttactcttacactagtggttctcgtcattgttttgtatgtaaggtggatatttggtgacttagacttatgatagtattaattggctcaattcctcatacatatatttttcatctaactttgtaccagtcattatgctaggtattagagatagaaaatcaggaagctgtggcctcttctctggcgaatcatgtactctagtgcagaagacagagagttattacaaacaaataactctatcatgctgtgatgaatataaaataggatgaatgaagtatggactgaaagcagagagagattaattctgcctggaaaaggcatgaaaactgtacaagggagttggcctttatgcagatcccaggaagatcttacccggccatagtgggagaaggacattacaggtgcagggagcagtgtgagggagtgcagaggattgggagacatggtggtgctccagatgctttgttggggtgataggcattcaaatgggaagaggggccaaggccagaatcggaaggaccttaaatgtcaggctaagaaacttgactaaaatagtttctgccaaagggataaaaaggagttttaaaagagagatatggctttgtctgcatagagaatggaaataaggagagcgacccattaggaggctgctggagtagtctatggtgaaggtgatgacaatcagaaccaaggcagaaacattggaaatgaagaagacaggtgatttgagaaggcttcaagaggaagaatgggcaagtcaggaaataatccagagaggggatccccagtcactgccttcccacattgctgaatgacctgtgaatcatatctgtggcagggaatcaaggcaggtcagctaaagagcttaaacatcttcactaacaacactaacaacaaagctgctacccaagaaacaaacttggctgtgtaagcctagcaaagaaaattgcctgctagaacaaaggaaatcacatttatcgggagataatatcaaaacccagaatgtccagaaattaatatccataatgtctaggatataatccaaaattacttaagatacaaataaccaggaaagtggaacacatgctcaaaataaaagaaagctaatcatttgacctggaaatggaacagatttctggaactgacaaagattttttgaaagctattataactatcctcaacgaattaacataagcctgttttgcaatgaatgaaaatctcagcagagaaatagaaaatctcagcagaaaacataaaggaaccaaatggggacttataaatagaacaataaaaattctgaaattaaaaaattcactggatagacttgataatttaattaccatgacttaggaaagattaaatgatagatcaatatccaaggtgaggctgggagtggtggttcatgcctataatcccagcactttgggaggccaaggcaggtggatcacttgagatcaggagtttgagaccagcctggccaacatagtgaaaccctgtctctactacaaatatgaaaattagctgggcgtggtggcacatatctgtggtcccagctacatgggaggctaaggcaggagaatcgcttggacctgggaggcagaggctgcagtgagcagaaatcacaccactgcactcagccagggtgtcagagtgagactctgtctcaaaagaaaaaaaaaaagaaaaagaaaaaaaagaaggaaattattcaaaatgaacagggagaaaatttgtttttagtgcgtcagaggcctgtgaagagatatccatctgcccaatttatgtgtaattaaaattctaggagagaaaatggataaagaagtagaaaaacaatttgtcaaattaacagctaaaaatgtgatgaaagacataccttggcaaatacaagatgctcagtgaacatcaaacaaaataaacacaaaacagctcaatctaaagcacatcacatcattagaggaatgcaaatcaaaaccataatgagacaccatctcatgccagttatcccagaacttgaaaaaaaaagtcaagaaacaacagatgttggcaaggttgcagagaaaatgtagcacttttacaccttggtgggaatgtaaattagttcaaccattatggaagacagtgtggcgattcctcaagatctagaagcagaaataccatttaaccttgcagtccaattactgggtatacacatgaaggaatataaatatttctagtataaagatatgtacacatgtatgttcactgcagcactgttcgcaatagcaaagacatggaatcaaccctaatgtccatcaatgatagactggatcaagaaaatatggtacatatacactatggaatactatactatgcagccacaaaaaggaacaagatcatgttttcttcagggacatggatggagctgaaagccattatcctcagcaaactaacacaggaacagaaaaccaaacaccgcatgttctcacttataagtgggaagtgaacagtgagaacatatggacacattgcagggaacaacacacactggggcctattgaggggaggcgttgggggagggagaacatcaggaagaatagctaatggatgctgggctttatacctagatgatgggtcgatctctgcagcaaaccacctttatacctaggtgataggttgatctgtgcagcaaaccagatttacctatgtaacaaacctgcacatcctgcacatgtaccccagaatttaaaataaaagttgaaggaaaaaagagaccaaaagaataaaagcacataacagtcagcttcaaaagccaaaggcagcacgtaaatcttaaaggcaccaaaagaaaaataatacgctctgggaaataattcaattaatggttgacttctcattaaaaaccatggtgaccagaagagagtggaacagagtttcaaaatgctgaaaggcaaaaaacaaaacaaaaaaccctataaactggaaatctatattcacagaaaatattcttcaagaataaaggttaaatgacattttcagataaaacaaatataaaataatgtgttttgccagcagacccatacaaaaagaaatcctaagggaatttcatcacggaagaaaatgatatacaatggaaactcaaatcttgataaagaataaaacacatcagaaatggccaattgtggataaatgcaaaagacatttttttctttttgactttttaattttaatttctttataaaccatgttgtgtcataaactaaaactataacattgtcttctgtaatacgtaaattatgttgatgtaatacacataacaagtataattgcgtggaagtggacacggacctgaaagcttaacaggtttctatagttaataagaagtggtacattattaactgcttctggactttgaaaatttaatggtatatattataacttctaagacaaccacaaaaaaagctaatgcaaagaaatgcaactaaaataggaaaattaaaattctaaagatatttaaacaataaaatgaaagccaaataatgagagagaaacaagacagaggagacacttagaaaacaaacaaacaaatgataaacccaaacccagccatataaatggttttcttatatgtgcatatggtatatttaaaggttagactatattattatccataaaaatgacgtttcaaaagactgaaatatatacagagtattctttgatccagtggatttaaattttaaaaatctataacaataagatggtcagataaactttaaatatttggaaattaacagatttcaaaatacctactgggcatatgagacatttgagggaaaattggaaataatttgaactgaataataatgtaattgagcatatcaaaatttgtgagacgtcactaatgctatacacacaggaaaaattttagctttaatagtttaactagaaaggaaaaaaaatatcaaaccaaagacctaggctttcatcttaacaagctagaagaaaagaagtaaattaaaagtgaagcaaaaagaaggaaggaataacaaagaaaagaaaataactttctgaagtagaatacagaaataatacacatgataatgccaagagcttgttctttgaaaggtcaataaaattggtaaatatccagtttggtcaagaaaaaaagaagacacaaatgaccaattcaggaaataaagtagggagataaatgcagatgccacgatcctactaaagcataacctgttatcttactaaaaagataatatgttattaattaatagaaaatgcatgcatattttttaaattaatatttttaaataaataatttatttttaaaataaaacaaaatttatactgatggggttcaggatatactaccaaaaaatatggcaccttggcagtggaggaaatagcagaaacaaaggtctctctgcccttcctccacacttctcccctaaagcaggtcatgcaagaatcctctgactttcttctgaagaaggttacaagactttcattctagaagtgtcattcttgtactcagaagaaaggaatttccttatttcacaagacacagggacacaaagaagaatgtcaaccaacaggccttgctaagttccccatttattaccattagatcacatcacctttcttcaattatacttctccataaatgtccaccattcatcaaaccaaagcataaaaatacacaggtttccctgtttctttggatgttcctgtctgaagtttcccatatcacataaaacttatgttacataaatgtgtatgtttttctcgtgttgatgtgtcttttgttgtaggtgcctcagccatgagaccctgatggtgaatgagaaaagatcttttctctcctacaataccaatacattttacaagctagatgacatggacaaatcatcaaatgactcctattttcaacaccgacctaagaagaaataggaaactgaagcagctctatttcggttaaagaacttgcatctgtaatttaaagccttctcacaaagaaaacttcatgcccagttggcttcattaattaattctatcaaatatttaaggcaaaaataataaaaacccaacataaattttttcagaaaatagaatagaatggaacacttcccaacttattttatgaagcagaaatactctcactctaaaaccagataaagaaatcacaagaaaaaaaagaattaagaccaatatccttcatgatcatgaggcaaaaatgcctggcaaaatattaacacataaaaatcaacaataggcctggcatggtgcctcacacctctaattccagcactttgagaggctgaggcagaagaattgcttgagctcagaggtctgaaaccagcctgaataacaaactgagacttaatctctacagaaatttaaaaaattagccaggcatggtggcatgtgcctgtggtcccagctacttgggaggctgagttgggaggatttcttgggtccaggagttcatggatgcagtaagccatgatcatgctactgcacttcagcctaggtaacagagcaagaccctgtctcaaaaaaaaaaaatcaatactatataaaacatgataatatatcatgaccaatgggtttatcttaggaatgcaaagttggtttaacatctgaaaatcaatgaacatagctcactgtattaatgacaataaaagagaaacctcataagataattgcaatagctgcacaaaaggcattttataataatcagcgttttatgataaaatctttcaacatcctaagaatagaagggaacttcctcacttattaaggtcatttatgaaaaaaaaattacacctaagttatattcaatgatgaaaagttcaatgctttctgcctaacattgggaacaatgaaaagatgtgttctaatgctgattttatttagcattgtaataaaggtcctggttagtgcagtaaagccaaaaaataaataaaaggtacacagatttgaaaggaaggagtagacctgtccttatttgcataacatgattgtgtatgttaaaaccctaagaagtatattttttaagtgaactagaacaaaaaagtgcattgagtaaagttgcaggacacaaaatcaatagacaaaattaactttataattacaaactaacaaataatgaaattaaacagtaataccatttacaatgaaaaaatattgggaaattttgggattaaattattaaaaagaaattcaacatctgtacatgaaaactactaaaattccaaaatgaagctaagaacgatctaaacaattagagatatgtactatgttcatggattggaataagcaatattttttaaatggctgttctccttagattgaattatagattcaatgtaataccaatcctagtcccaaatacttgtttgatgaaatcaacaagataattaaaaaatttatattgaaatacaaaggacctaaactatccaacacaattttgaaaaagtaaaacaaagtttgaggtcttatactacttgatttcaagacttactctaaagttacagtaatcaacacagtgtggcattggcataagaatagacacagatcaatggaatgggatagaaagtccagaaaaagaaatctacacatacattttcaattcatttttgacaaaaaaaaatgctgaagtaattcagtgggaaaaagacaatcttttcaacaacgtactggaataacaaacgagttatgtatctgaaaagaaaggaacgttgctgcttgttacatatactgtctaaaagataactaaaatttgatcgtagaccctaaatgaaagagctaaaattattagaattctaaaagaaaacatgagataaaatctttgtgacattgaggtaggcaaaaatttctcaggacactaaaaatatgaatcataaaagaaaaatacaaaaaatagatttcattcactttagattttttttttttattattatactttaagttctggggtacatgtgcagaatgtgcagttttgttacataggtatacacatgccatggtggtttgctgcacccatcaacccatcacctacattaggtatttttcctaatgctatccctcccctagtcccccatcccctgacaggccccagtgtttaaaaaattaattgggaaaagaataaggaaagccacaccctggtaaagaattttaaaaaatacatctcagacaaagactcatatccagaatgcttaaaggactcagtaataaattgtaaaaaaaaaaaaattaaaagtggacaaaatttttcaagatagtttgcaaaaaacctgcaaatcacccataatcacatgagaagatgttcattattactatgtatcatcaaaatgcaaattaaaacctcagtgagataccactacacacctgctagagtggctaatgtttaatagactgattttgccaactgatagtgaagaaatgatgtgcatgtgactcttatacaattgatggtggaaatgcaaaatggtatagctactttggaaaatagtttggcagtttcccataaagttaagtgcaaacataccatatgacccaacaatataatagctacaacctggcagcaatctaaattgtcactaatgcatgaatttgaatgcataaaaattgaggtctgtcagtcctatagattactcctttgtagtataagggaatgaaacattaatacatggaataacatggataaatctcaagatcattatggtaagtgaaaggagagaaacacaaaagactatgtaatgtgtgattctatttgtaagaaattctaggagaggcaaaactacataatgacaaaacagagcacttgttacctgggtctattgatggaatagatgatccacagtaaaggggcatagaggtctttcacatcccttgttagattcatttctagataggttatgttttgtgttatttttgtcaatggaaaaatataaaaactcatggaaagatgctaagaaaaatacctaaataaatggaaaggcagaccaagtacgcagaaggaagactcagggttgtaaaggtgtccagtttcctccaaatggaactttcaattgaatgaaatctcaatcagtttcccaggagaattctttactaatttaacaggctgaatgtaatgcatataaggctgaatctgacacatataataaacagcaaaatcctaaggaacaccaaacccttcgtgaaggaaactcataagggaaaatttccagatagcaagatgtactacaaaggtacataatttcacagtgtagtatcaatgcaggaatgagtcaactcatcaggggacacataaaaaaagtcccatgtgacccaatgactgcagatattcttgctgaaatattattgatcacatcacatcttatagagcgaataatgaccttctcaaattgtactgcaacaaatagttgcagatataaacatacaaaattagattcctacctcacaccatacattcatgtcatttcccagtgaattaaggctttattttttaaaggaaaattcaaaagtgtttcagaaaatatataggagaacattactatgaccatgtaatgggaaaatatttattatatatgtcatatcaaacacaaagggtaaacatttttactatattaataatttctgcttatcaaaatattttatatataaaacgaaaaccacaactaagaaaatgcactttcaacacataaaactaatgaatatttcatatgggatgtacaaaaaatctcttacaaatcaattagataaaaacattccaacagaaaaaagtgggcaaaataaataaaccaatgaattttataaaataagacaagaatagtaaataagcacatgaagagacttttaaactgattaacactctgatgatgcaaaataaaatcagagataccatttttacacccactgtattggaagatagtaagaagtttgaaaatagcaagttttagagaggatgtgagttatgagatctcattcactattggtgcctgttaaagtgtcataaccacttttgaaaataacttgtaaggttaagattcccataacccaggcaaaaccccgtctctactaaaaatacaaaaattagatcagcgtggtggtgcaagcttgtaatcccagctactgggaaggctgaggcaagagaatcacttgaacccagcaggcagaggttgcagtgagccgagatcatgccattacactccagcctgggcaacaagagtgaaactccgtcaaaaaaataaaaaaagaaaggaaggaaagaaggaaggaagaaagaaagaaaaagaaaaggaaaggagagaggaggggaggggagaggagaggagaggagagggaagaggagaggaagcaaaagtcttgtacatttttaccaaaagatgtaaagaagaatattcatggtagaatggtttgtaataacaataaaactaggaatgactggtatccattgtaatatacactagaatcgtgtacatcagtgagaactaagagccaagacagcatggactattatattcacctcagaaatatgatataatataaattactgaggaacacagtaaatatcaccttattaaggtcaaatgcaaaaaaaaactaaacaacatagtatttaaagatacataaatatgtgataaaactgttaaaagtaccggaatgataaaattcaggaggaaaaaaaagtaatcatacgttctaattctgaaatggtctcattggtttccgtagaaacaagcaggttttatgtacctcaaatgtagtacggcataatcttttttatgtatttatttattttattaagttccgggatacatgtgcaggatgtgcaggtttgtagcataggtaaatgtgtaccatggtggtttgctgcacctatcaacccatcacctaggtattaagccctgcatgcattagctatttatcctgatgctctccctcctcctgacccctgcaacaggccccagtgtatgtcgttcccctctctgtgttttcattgttcagctccccactgcatactcttaaacaatcattatgtttcatggtgatcagtaatgtgggggcggggtagaagcagagaacttggaactcgtgagggggtgtcaaaggtagtaaatcttcatccattgaaggcaaacttgatatttagaaattcattcagagtaaaagctaatggacgaagggagataaggtgacaatcaaattaagtagtaaccttttttgcaacttatataactaacaaacttaagtgctttctaaaaaaaaattctaaaatttgctatataagggcaacttcactgaaatgattgcagagtcttccatgtgagttcttttaatgtgagatagctcattcaatagatgcaccttggtgtgtttgcttaagaaacagaaaaatatgactcatttgatttgttcatgaaagtattaccaggaaaataaatgaaaacaatttcacctaaacatctgttaactttagcactgaagctttggatgtaatttacataatgcataaagtagattgatctaggaccatgtcgatgatgaaattttcattatattgatagactttcattttcctcataaaatctacacatacttaaattataacaactctgcttttgaattaatccagtctgcataatgtttttcagtcatcaactattatagtgtgaaatgcctttaccatcaaactggctcaaggttactgccttcactcagaaagatagtgttttccttctccccactgtgggccctgcctctcaacctgcaaccctacatttcagaaagtagtttgcctgtatgaaattttcttactctcttctaaggtagtggctgcaaaatggtacctatctctgattttaatttgcatcatcagagtgttaatgactttaagagtctactcatgtgcttacttactatttttgttttataaaatttcttggtgtacgcatgttctcactcataggtgggaattgaacaatgagaacacttggacacaggaaggggaacatcacacaccagggcctgttgtacggtggggggcagggggagggatagcattaggagaaatacctaatgtaaatgatgagttaatgggtgcagcacaccaacatggcacatgtatacatatgtaacaaacctgcatgttgtgcacatgtaccctagaacttaaagtataatacaaaaaagaaaaaaaaaaggcataaaaattctagaagaaaacattggaaagtgtctttatcatcttggagggtcaaagatctttctaattatggttcaaaactaagatgtcgttaaagatggatacatttgatgaaataaacatttttttaaattaaaaaaaattattggtgtatttattttgcctatttttttctgttggagtgtttttatctcattgattttggggagttgttttttatacaaccctacctttcagaaatacaccctttcattcataggagatatatatgtacatgtccatatgcataccattttgagtaagcgtttttactaattttctaaggggatgcttgaaatcttggttgttcatctacaagaggccagactcagcatctatgagatgtatagattcaaaggtattcatggcagcgaagagctaattcctccaagcaagagcacctaggggagctcgtggagcagatgaaagcatgttttgcaggatgtggctatgggccacaagcattctgcatacagatttactccaaagttggatataggaaattagtccctttactaacagttgtctttggctccttggagtatctgctttcttaatctgctctttgtgtcctgcccaagaacattctagctgttccaaaggttttcggtgtgtgcgcctgtgctttctatgtcaatgtgtaaagtaggagagaagcatcatgtgaggctggattaagaagagctgggcatattgcaccatattgaaagggccgtttgatgagtgggagcctatctttttttcagaactagtgattttactttacataagcattcgtcaaaagttgaggagagttccttgatgtttcatgtggtttttttctacttcctctcttacagatacagaattcatctacagagaacagaaaggaacagtgagactgtggaatgttgaaacaaatacttctactgtcttaatagaaggcaaaaaaattgtaagtactctctttaatgaccgggataatttcagtttttcttcctgcaagtcaataaaacagaaaatgacttttggtttcaacttttagcatagccaaggagaagcaataaacttgtaatactacaggctgagcaaccaaagataatgtgaaattgaaaccacgctaattcaataagatgaaagcactgtttctttcattgtctgggaaatttctctgcaggtgttgggaacaagtgttgcatatcatatataattaaaagataaagtcctaaggcttttacacatttacagaacaattgcaataatgcatgtagaatacttcaggagaatttgctcaatcctgtttaaaaaaagctcgtctccgcatgcataggaagtattaacttaggcactgtgactgtacttaccctaattatattaagtggatgcttatgcctcaaagtaaatactgagtcaatatgaatgccactgctttatgatttgggaaaacttgttttcccaaatatatgtatattttttgagacaggatctcactctgttgcccaggctggagcgaagtggtgcaatcatggctcatttgcagccttgacctcccaagctcaggcaatcctcccacctcagcctcctgagtagctgggactacaggcgtgtgccgccgtgcccagctaattgtttttgtttttgtttgtagagatagggtctcactatgttgcccaggctggtcttgaactcctgtactcaagcaatcctcctgctttggcctcccaaagtgccgggattacaggcctgagccactgtactcgaccccaaagatttaaatggcattaagatttgatgttcatgtacggttaaagatatgtattagaaatattgactggagttatacaccaaaatcaatttaaagagaattaacattttgtttgtttacaaaatgttcagactcttattagaataaataaatctccaactcaaagcagttgattcttttcttgtttgagacactggggaaatcaaaggacagaactaaggttaaagctatgttaaaaagcaagaattgaaacaggctgtgaatcccgttaaagcgatcataacagggctctggtatgaatcagaaacacagaaatcctagaatcctataatccgggattagaggaggttgtaaaaaaaattaaccggttccctggttttacagataaggatcctgagcgagacttagagcatgagcttttgagtctcacagctcagtgatggctgagggagcattcaggtggtgtcccagaagcctgtgtcccagggagaaggaaggatggcttcatctttaccctaccccatccccagatccacagaaatgctgtgctgccttcttttccctcctaaagaacatgtaacttgctatttaaatactttcatttcttttcttttgcataaagatacctttttattaaaaggtttgctgagatttagtattaaatgcatgctgcccctaacatagactgcaggcgtaagggaggcctcacgctgttggatgatggcatagttccaaaaatgatcactttattgaattaaatagtattctgcaaagtaggacctaggacaaatgaatgtgcctgcatttttgcattaaaaaaatcatctttggtagaattactcccctaagagaatctgattcaactcacttagaaatactaacgttgtagaaatggttttctaatattaatagagaggataaaatgatcagactgttgctgagcgtcagtgcattttaatgtcggaatgttatcattatttcctgtgaggatgtcagtttagtaaaggctgggtgttgtacataacagcagcacttagcaatgaaatacatgaatgtgaaccgccttctctttctaaaatcaatagcttgtgacagatcatatattttaactgaagttattttagccaagtcgcctttaataaggtgacttcagaaaccaccatgggtaaagaaaagttctcatctcagaaattcgctggcttattctatataatgcaatcttttttccttaaaatgtcacttttccatccattttataaacatttattaagcaccaaatatgtacagcctaatggattcattattcctttctcaaagctacatttaaatgctcctgtcaacagactcaaaataaagaagacaaaaaatgtcatttagaggtctgcatcctaatttaatttaatctggatttaatttccgcagagccacttagtcatttaaaattatcatgcctcaattgctctatctccaaattaaagctgatttcttctgccagcccagaacctgggtactctgtgagatccagcaatggaatatgtgtatgctctgtgtgttttcatgagcaagtatggagaaggtgaagcctggtgttccacaggggctggaggttggaggatcacccacagcctggaggaattgggaatggggagcagtagctcttccatattctgttctcttgccttcctggtgactgatcaggtgttctcttctcatttgaattccagaagctgtgagcttgtataaatgataaaaagcaatctgaggccaactgtaatttttaagttgggctataaaacagccttaaacaagttgagaaatggaaaggaattggtaaattctgtggtcagcagaattttaaaatattccctacaaccttgacctctaataacctcattctctttcccgagccaataaaaacagaccctcctcatagctggtcactgcaaggtaccaaagcctgtttgcctccagcttcttctttgctcctgcgcttactgtgattggctcttacatgggacaggtggatggaagggcctgcaaatcactgcaaacattttgtcaatccagcaggaaagcttttaagatagctggtgattaagcaaattcagagcttgtgctaagttctgtatttacatggatgtatttcacctttccttcccccaaacaatttcttttgactaaatttactaattcagtcatcctttattgtgcttttaaatggtagaaatcatgaaatatttcacaataccacaaacactttagattgttgagttcagaccaggtgcggtggttcatgcctgtaattccagcactttgagaggccaaggcgggtggatcacttgaagtcaggagttcgagaccagcatggccaatgtggtgaaaccccatctctactaaaaattaaaaagttagccgagcatggtggagcatgcctgtaatcccacctacttgggaagccgaggcaagagaaacgcttgaacctgagagttggaggttgcagtgagtcgacatcgttccactacacgccagcctgggcaacagagtgagactccatctcaaaaaaaaaaaaaaaaaaaagagtttctgtatgtgtaaacatttaaaattctatgatgattatattatggttcacaatttggggggcattcttttgttttatatatatatataaaacaaatatatatacacacaaatatatgtattttatatatatattttatatatatatatatagtgggctatttcctgatccttattatttgatagcatatcatatttgatggtagctaagaactgctttttagaaaacatttatcaaaatgtcttgatccatttcctcttttgagaatttttgaagtgcttgtctacatttctacagaaaatgaatcaaataaaagcacagttgtccccaaagcacaagtgcatcatctctgaagtagctctcctcagctgtaaaggctgctgcccagttctaagctcactggagcaggttctgtttgggatttaattttgtctcccacatagtgctcagcaccatgacctgcacatagtagatgctccactgctatgtgttttatgaatgaccgctctagaataacaaaacaatagagttgagcagttttccagaaacatccatgtgagtgacaggtgtggaggggcattcagcactggggtcatgactttgagcttcaggtctaccttccagccttggcattgtgctctgctcaggaacaacaggaccccagccggttgtgcaagttctgaatgtccagtcttatccctcaggagtgtcgtaggactgaattacagttgtaacagctggaatgtgggtatatgccacatgtggattccagagcgttaggctagaccaaagagcctgggccaggctcagggctcaggcaggaggagtgggttggttctatgaaggaagagacagaggatgatgatgtccaaaggagcatgacaaggatgctgccgcatgtgggcggctgcgtgggtccaggcagcagtagcagacagtggaatccacgccactttagttttgaggtccatccctcatgaagctggatgtagcctgcatcccagagtgaggcagaggcatccagagctggtaattacagcaagaggcactcgcagaactctaaacatcaataaaaaatcaaacctaagctcacttttatttgaattacatgtttgatgtcacagaaattccgggaccttacactttactcttttaaacacaattttaaatgtcaatgttattttacgtttcatgctccttataagactcttgtcaacaagatagcacatcttatcaaatggcctttgttctattatgtatcttgtttttttttcctaaaaaatgaaccaccacaaatatatctcatggtccaaaattggatctttggacatttggccaatggttgcctggttcctaaagtcctcatgaatttttatcttctgagtagaacactcctttttcctttccctccctccctccttttcttcatccttcactcctccctccctccctcccttccttccttccttccttccttccatccttccttccttccttccttccttccttgtagaaatacacttaaaatagccttaatacattttgctgaactaaatagatttcttggggacttaattcttacaaaaatttaacaccatctctccaattcttttaaaacataatagagcaaaaattatcagaagggtgaagtgtttcaccagtgcttaatatttagatatttaaagctgaaatagtctttagagactgtgtctttcaaactcttcttttatgaggtgaggaaactaagaatttctaagaacagttctctggcttaacctccactgatagtgctatggatgtaacgcaccagttcagaatgagtcactgtattgacctgtgtcactcatactgtataggccctttttattgacaatgctatcagtgacaagaagcattaagatttatatagtcattcattgtatcacttaaattctgccaggtgtttggaaagcaacttagtgatacgtttcaggagcagtaacaatattgatgcatttttatttgctctggggaatgcttctgtacaaagttgcagcattatttgttaatacaatagtgaaaatacttgaaactaggaaaatgagataactttttaaaaaaagataaaatatgatgtattcattaaaataatagctatgaagggtatgtagcgatacaaaaaatatttatgatatattttaaaaagatacaatatactaggctaacaactatatatattgaaaggctagaaagtgaacactgaactatgaaaatacttaatcttgttgggtggtgagattttgtgtattattttctagtgtggtgatttccataactgccatttcaatgccatttattcaataattttaatcgggatttaaaaattttggtttcatctttcaaaaaacagcagactgccttctcacaatgagtatgtaagagctgtagacagttcccggaaattcttgaaggagaaaataagtcgattatttaaaaaaaaaaaaaaaagtattctattgttatgcttatgtcaggctttctccatttttatgtcttgttttaattactaatttctttgttttaattgcttattttaatgactaaattaacatctaaatgaaatgtattttctctaagctgtatccttcttggttttatataatcatagatgtagaatttgaatttttatctctgtctctaaaaattaattaattctgactcctcacagaaagagacataaataggcaagtattattagacccattccaaaataagaagaacaaataataggcctgtttgtactaccagaggaactccagaatgtggctgagattagaactcgagactactttctttttacttcttcaaataaactccactggatacttgacccctgcatcagtaattctcactttattctatgtcatttaatttctgttaagtgctttatgcgctagtcctctcagccctgaaacagggtaaatttggaaggaaacagaagcccactttcttacctctttctcttttctgttctgcacagagcccagtgcactgttgaatgggaagcacaggatgttctgacaggtgtcatctcagccaggaacaggctggcccccgggaagtgggctcagcctcggtttcagctcctgttgtcctgagttcactgaccactgataaccaggacggtggctgcaacttcagtgggccagcaatggcccatgagccatctctaatctgaggctggatttcacttagcatgtcagtgaaaaccatgaggggaaacagccgtgtttttgtgtacggttgagagggcataaactggcagctcgtgatgcccactgaaatgttttgtttggcccacagagtggtttttacaaactaacccagatttctggcgtctcttgaaaaatacaaagatctggcagcagcaagatcctcatttgctcacagagagcaaaatttggctggagctaagaggcagctggcccctcagacaggacatgggccgaccagccctgcagtgacccacatttgctgacttctaaccagactggtctctgagtttgaaaccccttttagttcaggaacaaaagggtggcataagaactcaatgtcttctgcaagaacgttgcacattgtgagaaatcgtagcacaaactgtcttggtattatctgtattcatttctgtctgtaaaattccctggatcctctttgtccccctatgtcattatttcatttttctcctgtgtctcagagggtctctctctctctttttttttcttttgtctttcttgtcctacttttctctctcctgccttttctgtttctacttctcttactacaagatagaacagaaaacaagtatattttacttacttttattctaacttttaccacatagaccatgattttactttttaaagtggatgaggctgagcacagtggctcacgcgtgtaatcccagcactttgggaggccgaggcgggcagatcacttgaggtcaggagttcaagaccagcctggccaacatggtgaaaccccatctctactaaaaataaaaaaattagtgtggcgtggtggcaggcgcctgtaatcccagctactcaggaggctgaggcaggagaattgcgtgaaccggggaggtggaggctgcagtgagcagagaacacgccactgtactccagcctgggcaacagagagaaactccatctcaaagtaaaataaaaataataaataagtacagtagatgagtatttatacttatgtctttaaaatatctgaaaagaggccgggcgcagtggctcacgcctgtaatcccagcactttgggaggctgaggtgggcggatcacaaggtttaggagcttgaaaccagcctggccaatatggtgacaccccatctctatgcctgtagtcccagctactcgggaggctgaggcagacgaatcgcttgaacccaggaggcagagggtacagtgagccgagatggtgccattgcactccagcctgggtgacagcgagactccatctcaaaaaaaaaaaaaaaaaaattctgaaaagcagtacagtagtggtttaatctttctggccccagagctactgttccctgcaggctaagggctgtgtaccatcactcctccatcacacgtatactcttcaagtgacagtcagggaaggccttctctgtgcaaggccctgactagacatggtggtgggtggatacagtgattaataaaaacagatttctactcttatgtagctttcagcctgcatataaaagaagtagttgttttaacataatatattttgcaacggaggtattaatccaatgtgcaatgagaacaaggtgagaaagaaagaggattgctgggaactctagatagaggcttgcagaaggaacatttcagcagtccttgaacatgggagaaaagtcggaaatggcataataggcaaaatgaaaagggtggataattccacatttcaggggtagacagtgcggttagtaggttgttttgggaggggcttgaaaagttgtggctggaaggtctggggaaaaggtggagagaggtcttcaggaagcttccattgtgtgtagtctttagtctgtagcacatggaaaggtgtcaaccaaaattaaagctactgaagcagaaatgatgtaataaaggtttattggaagccacaggtgagaatcgatctgggaaaacacaccaacaaagttggacatgttccagaatctgttacaagccagaaggctttcataagaaagtttaggagaagtgaaggggactcctcatatcagagttgtcctttatcattaagaggtacaataaaaaggttccaatcactgacaacagattgcaacacacaggctaaaatgcctacgtgcaagacaatcagtaaaacttcatgattcagaggcaaatcagcatccttttcaatgtcagtagatcacacagtaatcagtacgtcaacaatttgaagagctcacagtaagattgtttacttagcgacaagatgacacacaagacttcttccccaggtgacttaatttggaagtttgccaaatgtgacctgtagggtattatttccctcttttgattaaaaaaacaacaacaactaaccatggaagcattgatgatcagtctctgcttacgttagaagggtagacatccttctttccttccttggctctgcgaaggctcattcccaagaagtcatgtccctgagtggggagaacaaaccttatcatcgcatgtgggccaggttgctagcaacatggggtagatcatgacacgaggttacatgccaatctcctgaataatgaatcaacctccagtctctggacgatcattattttggccttaactgtggaggcatagtttacaaattctggagaattcaggtacagagaaaggtaaatgttttaattttattcacaaaagtatactttacctgattgttttaaaatacaaatagctcctttatttataatttttagaaatatgttttgctatagtattgttattttatttggaaataaagaatgagtattatttaaattgaacataactttaagattgaaaattatgtaacaattatttataaaagtttatcccatttatatttacctaatttatttatttttaacagtttacctggattgctcatgaaaactgagatattggacaaagttagtcattatttcaagttacttccttgttaaccatttttatggcctgtgaatatcagatgttcacttaaggaaggagtttaggttaaatatatgggtattttgctaataactcagaagatacagctttttttcatttaaccaacaagattaaattagtcttacccttcaaaaaattacacaaaaatcattctggttttggctgggcttgtagttctataacctttgtgccaaaccctgacatttaaaaatatctagcagagacaaatataaaattgtcttccaagtataatgaggcaaaagggtatgctgacaatcttgaagacatttctacttttattttatcaataatttaaaaaccagcttgtttattaagggtttacttaagtcatgtgaacttgggaaatatttgtgtttactaatttatgaatgctcatttatttatgttgatttggtaccaggtagacataacatataatacatctaagtaagtgtaaacacatctaaacatacacaaacacaaataaagattgtacagctttcattttagaattttagttctttttttttttttttttttgagacgaagttttgctcttgttgcccaagctggagtgcaatggcgcgatctcggctcactgcaacctccgtctcccaggttcaagcgattcactggcctcagcctcctaaatagctgggattacaggcgagtgccaccatgcccggctaattttttgtatttttagtagagacagggtttcaccatacaaactcaccaatttataaaagacagctggatccaagttatatttctgacaaaattgggacctattcatatggctaaactttttttgcccctatgggtaatctaatgaaagctacagaccaaaagtttgggtaaagcagtttccatgtaagtttgatttttacaaacttcttttaccattttttataagtttcaaatgagttcaattttcaatgtttacattttacctgaaaactgaccaaattgcataacaaagacaaaatctccaagtagtcttgaaatagtaacaaatctatcttttgtttgctgatcttgtttgattagcaaatgcaggtggggaaaaatttttagcagtttctctcttttttgggggaggtggcactttttcctttcagcctttgtagcagaaaaagcaaaatttttgtgctagacacagatagatgattgctctgagctcaagattctgacttattagacctgagggcctaacttttctaaacatttatctttttcttttagattattaattgttcaattaagcatttcattttaatacgagtggctgaatctattttaccaatgccagtggaagatcgggatcataaatggtctggcaaagcttacaataaatcaattggtatcattcattagtttcagtttagaaaaaaacttgttggatctgtatttttatcatctcagtaatttcattctcatgctgtagtcctttcatttgctccttttgttccaaattcatacatttccctcttttgagagagaaggaaatgtgtgcattgtgaaattccaaaaatctctgcctaagaaatgtatgggagctgagggaacaagcagagaaggatgaggaatgaggagcagttggaggtgaaagggacaaagtctctgaagtctttttcacggcagagatagttgcgaatatccttttgtttacctcttgaatggaggcaattttttctttcaaaattttttatggaagcttctaggtgctattggaagtaagtcttccattcaatttgtctaattctaaatccagctttttccaattgtgtgcccaagtaaatcattttaggcatttcaaagggtccccattttgggtgttgctgcttatgaccatgccaagttaggtggatccacttatctaagcacttgcaggtaaaaggaccaaaagtattgtgcataaaaccagctggtgttgattagaggcagtgcactgtcagtctcagaagacctgctttccatcgtgattgttttgagtgagaccagctatgtagtggagcaaaagtgcccctcatgccatcactaaggaaaagtgctttcgccccaaacctccagggaaaaattcacagagctactttaccttgccctaaaattcaaacaaaaacccttaccttggattggtaagagggatactcgttctgagaaagacattgtattttctagccaaggagaaagccagcttcaaaaaaatcacaactttgaccaagacgggaagtttgttgatttcaggaagaactcatctgtaccacccagcaggggcgtccaagctcacaatgggtttgttgccaggatctgcatgaaggctggaagctgtgctggatggtccatggaggtcactccaaagcctactggctacaccataatgttgacagaaattaaggctgaaataacgtgataaaaggtgtattggaagccaaatgtgaggatcagcccaggaagacacatcaacaaagtcaggagtgttctagagtctttaacaagttggaaggcttttataagaaagcttaagagaagggaggggactcctcatatctgagttgtccttttcattggagggtatgatacagggcttataatcattggctacggattgcaacatacaggctgaaatgtctgtatgcaagaaaattagtaaaacttcttgattcagaaacagatcagcattttttcaatgtcagtaagtcatacaaataatcagccacatcaacaatttgaggaactcaaggtaagatactttactcagggacaagatgtcaccatgcatcacaagaccttcccccaggtgggttagaatttttgagctggttagaatttaaagccaccgtgctttaggaaaataactgtaaccaataagaaaggggtttgtagaaggtaaagattataaacaaaacatcgacagtggctgcttcaagtccaggtgaatgtgatggaggtcttaaattaaggcagtggctttgaagacacaggagaagttggtttaagttacatcacaggagtagaattgataacacttggcttcactttgtgtacaggcagatgggattaaacaatagtctatgttgtctggggtttttcgagacttgctcatgggtggagagatgtcaaattcagaaactgaaatggggagagaaacagattgtgaagtagaaaaccaaagccactttgaggaataagctactgcaaggtatatgcagagttcattaactaatagttgatattttgagtgcttacggtgtgactaaagaatcctaaacactctacgttcattatcttacttaaccaaaatccttaggaactctgtgagcttcagtactttattattattttaaaactcagaaaaaagaggttaaaaaaccttttactaagtcacacagctgatagctgatagtcctgagagctgaagtcagctttgtctagttccaaactaaattatttctagactgcatacataatccagctgtagccttggtcgctgcagttataagatagggctgaggccgccattccattactgagaaggaagccaccgcttcaaacactgtgttcatatctgtgagtccatcattacatatcacgtggttactcctggaggccactacatttgccctaaaatgaagactagagatgcaaaacattgagtcagtttagcctaatgccaaaaaaaaaaaaaaaaaaaaaagtgctgacacagctgagtcctggggaacgatctgtttcaaggttagagagaaccgagctgtaaaccatctggacgctttttcgatgtggctatttaatcatctttccactctgctctatagcatctatgttttcaggttttctctgactcagtaaatgcagtgctgggagcagcacccgagtctgtctgattcaaaattaaattattcttaggtgaattcagggcccagaggcaggctgtggccactatcattaacattatcgccaggcccaagggttctgtctttctcattgaccaggaagggagaatacaatcatctatttatgttaaatttgatgtgtgcacccacagagttgcacatagcatcctcctgtaacaatcttttcagtatttgtcttttgttgatcattactcatcttgtatatttagggttttttttcattatgagtttcatgaggaggttgtattcaaaaaagcctctgggtatatttatgctttctaccattcatttcccttccattacttgacaaattgggggcattctatcattttatatctcttttttccctaacaaccaccttttcttctctgcatttattatcacatatgtatttatctactacaggaaaaacaaaccaatcctttagttagatatgtatctcctcagaaacatgcctagaattttatataaatgggatcatcatacatgtagaccaatatttttaaagtcagcataatgttatttaaacttgtgttattgatataactggtagccccagataatgcaaaaggtgaaatactgtatatacccatctctctagtaagtataaaagttatgagcaaaatattaacaagtggagttcagctgtgtaccaaaatcataatatgctaaagtcaggtttaatgattacaacagcatttaaatatcaggaaatcaatcaacaaaatttattagaactacaaaatgatagaaaaatccttatgattaagtcactaggtgctgaaaaagggatctgataaagtttatcaacagctcctaataaaaatccttgctaatgtaagaataaataattgcttaaatatgctaaaggttgtttaccaagaaccaaccatcagtgaaaaccattctaaatgacaaacaataaaaccatttcaattatagccaggtatcaggcaagaatactcaccatcaccattaatatttaatatgttcttgaagaaagtgcaaccaaaccaaatgattcaaataagaactagaaaatagaagaaaaaaagacaacttttttctcataatagaattttatttctgaaaaacctaacatatattagttttaatatacaccatggaatactatgcagccataaaaaatgatgagttcatgtcctttgtagggacatggatgaagctggaaaccatcattcccagcaaactattgcaaggacaaaaaaccaaacaccacatgttctcactcataggtgggaattgaacaatgagaacacttggacacaggaaggggaacatcacacaccggcgactgttgtggggtgggggaaggggggacggatagcattaggagatatacctaatgctaaatgacgagttaatgggtgcagcacaccaacatggcacatgtatacatatgtaacaaacctgcatgttgcgcacatgtaccctaaaacttaaagtataataataataaaataaaatttaaaaaaatccaaatgtcaaaaaaaactaataagaacatatcttaatatggctaaatacaagaaatatattatgaaatcaatagcttttctcttcaccaatataaataccttgaagtgaaaatggagaaaatattccattcacaataagaacaaaaatataaaaagacttcaaataaatctgacatgaactccagaagattgaacaaagcaaactataagatcttgttagaaatttgaaaacattaaaaaaattgtataatattaaataagaaaacaatatttaaaatgttaattatttgaaagttgatatcaaactttaacacaatcctaattagaactctgaaactgctttagtgtaaacattttgcaaaatgatcttgattgtcatatataagaataaacacctttgtgtagccatgaagcatttcaaaatgcatagtaatgtatactcttttacctgcagtgaaaacacacaagaacgacgttatattcaactcaatgacaataatagctaacgctttgaatacttattatgtaccaggtattgtaattactttattaaatttgtgtatcaattatgaggtaggtacaaatattatctacactttacagaggcataaaaaattgagaaattttcagcatctctcatagtgaatggtataaacaggatatgaatcacagtctgtctgaatccacagtccaagcttaaaactatcaaattttgcatagaagtagcaaagagagtgctgaaaaactggagaatttgaaagaagcttccaatataaacaagtatttgacatgagaaacactagggatagggtgacacacttagaacacagtgctggcataactaactcttcatctacaaagatgtaatgtaagtctcattgtacaaatacacaaaattacgttccaattggattaaagccttaaatgtttttaaaagtctataatttggtttcataaaaagagagaaatttttaatcaaaataggaaatcctgaagctataaaagatagccatatttaatttgccatatatgattttaaattttaattttaagaaaggcaaaattagtagacaaacaatggaaaatatttacaatccaggtaacaagtaaaaggagtatatctacaactgataaggaattcttccaaattgagcacaaaaagacaaataaataatagaaaatgaacaaaaatattttagaattagctcaatcaagcctgaaaccaaggcctgctttgtttgggaaattgatacatagagcaaacgttcaggaatgtgttagatgtttttttgcattcactattggcacttggtgagaaggtagacctgcagctcaaaatttgtacaactgctacaggatcccttgaatttgtaacagggccactcgttctgagaaagacattgtattttctagccaaggagaaagccagcttcaaaaaatcacaacttcgaccaagacgggaagtttgttgatttcagggagaactcatctgtagcacccatcgggggcatccaagcttatccaccagataagtggagccacctaacctggcatggtcacaagcagccaagtccaaaatggagactggggtggtcagaaatgcctggaatcacacctaaccatggcagtggtgagtttctcaaagagaaaacaaattctcactgtctccggcagcatcgttagcaattgaccctccatcaaggaatgtgacccggactaatttctaagtgtaaaagttgcattctttgctggtttcttttggtgttattgcgtatcagccccactgttgccactcttgtaacagctgaggatgtaatcattcatttcttcagcaaacatctagggagcatctctattataacccagtcaccgttaggcactgggaatagaaccgtggcaaaacaaactaaaatttgcttcttggcatctggtcctggccatgagactataagaggattggaattaccctcctaacataaacaactataaaatgggataaaatgtggagagaaaaatcagttttcatgtattggacagcaggcagtgcacagctgtgatccccgagaaaagaaaaacaaatgaatgaaccatgccatcccgtgggctttctgcgtgaatgctgtactgcagcacgaaggggaaaaattcaagacctgcagtcttgccaagttaagaagacagaagtcagagttcaagaaaagaagatggctacagtttatgagatggagtacccaaaaggaggaaactagagaatactcacaaaatctatttaagtaattccttttaatggcaaaaccacaattactttattattattattatactttaagttctggggtacatgtgcagaatgtgtaggtttgttacgtaggtatacacgtgccacagtggtttgctgcacccatcaacccatcacctacattagggatttctcctaatgctatccctccctttacccctccacccccccacaggccccagtatatgatgttcccctccctgtgtccatgtgttctcaatgttgaactcccacttatgagtaagaacatgtggtgtttgaaaaaccgcagttacttttgcaccagcctaatacatagatttccctttgagacctcggttaattattgacctttatatgtgaataatgaaacaccaaaaggcagaacaaaataaaactccaaggaaataacaattacagaactctgttagatgaagtattcccagagctcatatattgtcaggaattatttaagtttattctaaccatgagacattaaacagagaccccaggaaagtagtttcttaggatgaggttcaattagcactcaaatatagtcatgtgtcacataatggcatcttagtcaacaatggatgtaggacattggtcccctaagattataatatcatatttttattgtatcttttttatgtttagatatttttagatatacaaaaattaccgctgtgttacaactctctacagttttcagtagagtaacatgctgtacaggcttggagccttggagcaataggctatgccatatggcctaggtgtggagtaggctgtaccatctaggttcgtgtaggtactttctgtgatgtttgcacaatggcagaatcgcccaatggtacatttctcagaacatatcagatatattgttaagtgatgcatgactaatggccactatggaataacccttaaaacatcttttttaaaaaccttgaataagtcaggttaatccacaaataattaattgcctgtcataaaaagtccaatattctttgaaggaaaacaaaaagtcctaaattcaacaagagagaattaaaaatatctggtgttaatttaaaaataaaacatgatatatgcaaaggagcagggaaatgtgactcctaatgaggagaaatatcagttgatagaaacagaactcctgataacaaagataagggaattagcagaaaaacacatgaaaactgctaagataaatgtattccaaatgctcaaggctataaggaaaaccatgaacatgatgataagagaaattaaagattataagacacccagataaaatttccagagattaaaaaaaaaaaaaattctctagatgatcaccaggttagataccacagaagaaaaaaaaaaaacccctaaattgtaagcagtagcaatagaaaactatttaaaaccaagaacaaagagaaacttgaaaaaaaaaaaagcctgaacagcatgtcaataagctgttggacagtataaagtagactaatatacctgtcattaaagttccagaaagtgaagagagaaaagaagataaaacaaacttttgaagaaataatgactgaatttcttccaaatttggtaaagaactcaataaactccataaagaaaataataacaaagaatatgataatcaagttacttaagatgagtgacaaatagaacatcttaatggcagccaaaggagcgagacgtgtttggaagaacaaacctaagaaaacagctgactcttcaacagaggtgctgcgagccagaggacattggaatgagatcatttaaagtgctgggaggcataaaacactgtcagtctacagttctacacaccacagaaatatctctcaaaaataaacattaagaatttgtataggcccagctactcaagaggctgaggcagaaggatcccttgagcctaggagtttatggctgcagtcagctatgatcacaccactgcaccccagcctgggcaacagaatgagacctttttctcttaaaaaaaataatatatatagatatatatataaagatatagatatatataagatatatataaagatatagacatatataaacatatatatataaagatatatattttcagagaaaatcagacagtatttattggccataaacctatactatgagaaacttaagggaagttctttggagtaagaaaaattacaccagatgaaaagttacatctacatgacagaaggaggtgtgccaggaatgataaatgttgtcaacatatggccaggttttgggtggaaatttttgtagaattagttaactagttctttaaaatatccttccttttctcaaagggtcctttaaatataataaaatatgtccagctcctctgaatgtaatctcatgtaagacttctgtctgaacctttgtcctgctctaaacactgacatggaaagtgaaaatataaacacataaaacctttggaacatgttagaactttcttggacaatagtggcaataataaatctgatctaatatagggtggactataactgacagtttaaaggacagatttcctatatcattatgcctacaagctccccttaatactcctggaggattttatattttgtttaaaaggaaagatccaattataagctatctatgttatctaattttaatataaagacatagattaaaattaagtgaattttaaagctgggcatggtggctcatgcctgtaatcccatcactttggaaggctgagactggcagattacctgaggtcagagttcgagaccaacctggccaacattgtgaaaccacatctctgctaaaaatataaaagttaaccaggtatgatggtgggcgcctgttatcccagcagctcgggaggctgaggcaggacaatcgcttgaacccaggatgcagaggttgccgtgaactgagatcatgccactgcactccagcctgggtgacagagtgagactccgtcttaaaaaaaaaaaaaaaaaatgaaatggattttaagagatataccatccaaaccctagtcaatgaaaatcttgaatggctatattaatattagataaaatagacaacaaggaatattaccagaaataagaagaaatatttcataatgataaaggagtaagtttattaagaagacttaagaatcctaaagatgtatgcagctagcattgagctacaatatttgaagcaataattggttgaaccaaaagaagaaatagacaaatccataatttaagttgtagatcccaacaatcctctctgagtaattgatagactatgtaaaaacatttaataaggatacggaagtcttgaaaacactattaaccaagtcaaccgaattgacatgtgtgcatcacatcactcatcaatagaaaaatgcacattcctctgagtgcacgtgaaacattcaccagagtagactatatgctgggccattaaacaagtctcaatatattgcaaaggatggaaattatacaaagtatgttctttaacagaaacaaactagaaatcaataccagaaaaaatatctggaatgtatcttgataattggaaattgaacaacatatttctaaataacaaatcagccaaagaagaaactgaatgtattttaagtgaatgaaaataaaagcaataatatcaaaatttacggtatgcaacaaagcaatacttaaaggggaatttatatctttaactgttcatattagatctcagctttcacttcaataaactaggaaaaaagatttaaaaccccaagtacacagaagaatagttaggagcagaaatcaactacacagaaaacagaaaaatgttagaaaaaatgaccagctgttttttggaaaagatcaataaaatcaatcaagagcaaagataatggaaaaaaaatcagacaccaagcaaacatattaataatttggacaatataaatgaaacagaaaagtccttgaaagacacaaagtattacagttcaccagttaagaaataagtaacctgaatacctggatattggtgtaataaattgaattcgtagtttaaaagccccacatattaaaactcaaggcccaaattgattcacttgatcaattctaccaaacatttatgtaagaaatagtaccaattctgcacaaacttattagacaaatagaagaggaggaagatatatttccaaaattcatttcttagggcagtattaccctgaaataaaaaccaaacaaagaagttaaaagaaaataaaaccacagatgacattccctcatgaacacagatgcaaaaatcctcaacaaaatattagcaaattgagtccaacaatatataaaaaggggtaatacatcacggtcgaatagcttatcccagcatgcaaggttggtttaacattagaaatcaaacaatgtaatttaccatattgacagattaagactaaaaaagcaaaataacataatcatctcaataaatgcagaaaaagcatttgagaaaattaaacatacattcattataaaaactctgagcaaactagaaatagacaggaatatcttcaacctgataaaagatatctattaaaaataccataaatatcatacttaatggagaagaatgaaggctttctcctcaagattagggaaaaaagcaaggctgttcactctcactacttctactcagcattatactagcagttctctagagtgcaataaggcaaccaaaagcaataaaaagtgtctagatagaaaagaaaggaaatacctatatacacaggaaatatgattttgtagaaaattctaagaaatatacagaaaatatctaccagaacaaataattacatgtatcaatgctacagaaaataaggtcaggatacccaaatgaattttgcatattagcaataatcaattaaatatttaaattaaaatatacatgtacttttatatgtacaaagcatcaattatagtacatccttgggaataaatttacaaaatatgggcaaaatctgtattctgaaaactgcaaaacattgctgagagaaattaaagattaaaaccatcttcctttcaaggtgtttacactctaatgaagaaagcaggcaatatttaagataaataggttaaaaaatataaaatatgtattaatatgattagacctagagaaacaaatcagagaaaggggtataaaaagtcggaggcaaggcagttaatatctagatatattagctattgaaggacatggaaggcctcacttagaaggtgacttgagataaaagccaaagaaatgaaaggttgagagcatttcaggcagaagaaagaggagttgcaaaggccttgagaatggcatgtgcctggcttgctttaggatggacagagactggcgtggctgcagtgaagcagatgggactgaggggagaatactgggagatggatgcagagagctaagagggaactaggtccagcagggctgcctggtcagtcaggactttggcttttcccacaggtgagatgggaagctgtgggagggtttcccaggggagcgatgtgatttacatatttgagagatggccctggccgcctgggaaagcaggtagaaggccactgcagtacctcaggaaagaatgcacataccttagacaagggtaatggtggtgggaaagagaagaaatggttccaaacctattttgaaggtaaaccaatggtattttctgaccacctagatgtagggtgtgtaaaacagagggaaagagaaaagatagccaagagtttgacctaacaaccaagctaatggggttgccactatctgagaagaggaaaaaggttacaggagctggaggtgtgggagtggagtagaagggtctcagcttattcccattgacttgaggtatccatttgacactcaagtacagatgtcagggaggcagttggccagacaagcctgaagttcaaggtcaggtccagtgcgggttcaggtggtctgggctggagacatgaatgttggaatcctcagccagactgcgcatggtttttagaaccatgagactggataacaccacctaggaagtgaggagatccaaatatcaatccttgagcactccaacattcagagctcaagaaaacaaggagaagcacaaaatagcatgaaaagaaccagcgagggaggtaggagaaaagcaggtgatgagtgtccgggaagccaggtacagtcagggcttcgaggagtagagagactggtcatctgtgtcaagtaagaggacagctgagaaattatgacatttagcaaagtgagtctctgataaccttgagaagagtaattgtggttgagtggtgggggtgagagcatgacaggcaggagtttaagaatgaataggaggagaaaaatggaagcatggagaatattttcaaggggaagtagacagacagttttctaaagataaaatcaacattgtctaaaacgtggatagtaaggatcaaatgtatccataagcagggaaacaaaaactaatgaggcatgtttacatctacaggagggtcaaaattggagaaaaaacaccttatgcttccagagaagggaagaaaacatgcattcatacatctgtagtgggagtgcacattccaaaaacatttttgaaaaagaatttggcaatacctatttaattttaaaatttgtaaactgttcacttcacccgtggatatctattctatacaaaaatgtgaaaaccacacatatatcaacaaagacatagattgggatcttcattacaacattgtttatagaaagagctcactagaaatgcttataatctatcctcattattcacagcttctatatttccaaattcaaccatgtgataaagtgtacctgtgagccccaaggtgataatcacagcacttttgccatcgttctcaggcatagtggcagaagattcgagttgtccaatgttggcattcccaactgcagcagaacaaagcactattctgctttctcatttcaactttcatgctgtgaacaactgtccttttctgttgttctatttggtgctccatttttttgcatgtttgtaacttacactggtgatctcactgttgaaagtgggtcccaggcatagtgctgaagtactgtatagtatcactaagggcaagaaggctgtgaacgccttatggagaaaatgcatctttgagataagctttgcttaggcacaactcatgggttgttggccatgagtccaatgtttatgaatcaacaatatatattcaataaggtgtccttaaaaagaaagacacataaaacaaggttatctattgatcatttgactaaaatgtttagactagaggttcaaaggaagctaacgttgagtctctcctagaagcaatggttcagtatccactagttgcacatgaactagtgttcatgatgactttatagaacaaagcaaccataaataacaggaatgaattgtctccctttgttgagaattgtgtgagtaaattaaagtatatcccaaggtgtgcaccatgtgatattacgagccctttaaagatcactactcaatcaaaggaacccaagtccttggagtcatttccttaaggtactgttgcatgagaaaactaaggtgcagaggaccataatatgatgtcactttttttttcttttggagatggagtgtcgctcttgtcgcccaggctggagtgcaatggcgcgatctcggtccgccacaacctctgccgtccaggttcaagtgattctcctgcctcagcctcctaagtagctgggattacaggcatgcaccaccatacccagctaattttgtaattttagtggagacggagtttctccatattggtcaggctggtctcgaactcctgacctcaggtgatccacccgcctcggcctcccaaagtgctgggattacaggcgtgagccactgcgcccagccaatgtgatgtcatttctaacctttgtcatctctctctgatttcatgtggttgcctgagcatgcatagagtgatgtccaccaagtcagcaatgtgggctctgggggtgggtgtgggtatctgtggagcaatgtgcttgcagtgcagagggcaggggcaattaaaagaaaacagcacagttgatggtatcatttatgtcggatgatgtttgtactatgaagaaatttgaaggaaaaagtcacagttagtcttctatgtactgacttgtagggatgaccatgttggaaaaagagcaagttgcaaaataatgtgtgcaatgtgattctattctagtaacaactctgcttattatatgtgtcttagaattagtgagaaaaaggtttctaaacatatcaagaggttgagagttttgtagaaaagtttgctttttaacgcttatttctttttcttttcttgctctctctatttttttttctgagatggaatttcactcttgttgcccaggctggagtgcaatggcccaatcttggctaactgcaacctctgcctcccaggttcaagtgattttcatgcctcagcctcccaagtatctgggtctacaggcatgcactaccacacctagctaattttgtattttttttcttttttagtagggatggggtttcaccatgttggccaggctggtcttgaactcctgacctcaggtgatccacccacctcggcctcccaaagtgctgggattacaggtgtgagccagtgcacccagcctttaatgcttatttatattggcttgtctcagtaagtccaataagtatgttttgttgaaatttgaaaaaaaatacaaataaaatatgaaaaaacatcaattagctaaatattattcagctaacaaagaaaggatatagccattttaatagctaattaattttgaaaatggcaccagcagatacaattttattataagattctgacttgttgtatgtaatgctttaaaattctttgtctattttttcttttaggaatcattaagagccatcagatatgaaatatctccagatagagagtatgcacttttttcatacaatgtggaacccgtgagtattatcctttactgcctacaaaataattgtttctttattctaatatctcattaagtatatttccttgactcttctatacttagtgatctttgaatccagaaatactttgtacatcctggaagtctcttttgcatatcatactgccacctaggagagaggaaaggtataaatatctgcttggcaggggaaaaaagtcacatactttagaggctctttcatagacttttcttaggaggatggtaagaacttgtctcttcatagacacaaatcttgcccttttgtgcaattatttttctggctgttttctcagtgaaataatagattttatcctaagaacaaaaagcaactgccaggttctccttaaactgaaataatatgttaattatctcctggtcattgtagtgttctagtgaagagctgaagctatcacttccactatttaaatgcctatttttagcacttcctgtatatatgagcctcccataaaatttcaccagaattttctgtaaaatctcactgtgtattagtagcagtgtaaaacttcctaggccaggatcttccttcttcttcttgttttttcatttgacatgctcgtatttcaaatttcattttggctctttaattttaaatagttggaaggtgaagtttatttgtataagtggagaggatgttcagtttacaagagataagcaactttagaaatgtatgttttaagaactttcctctctggcaaataagatatagagtctactactgcctccctggcatttctgagaccatttgaaatagagtttcctggtgcttctgtgaggtgtaatgactcctgcattttaattcaggtcagaatggctctgtggtgagtttgagagaatcttttctggcatgagacagtcaagctttttggtttatatccactgggaaagctggggtattggtttgtatgaagatgcaagttcaattctgaattcttaaactttcttttagaagttgattggacaactggattactggagatttcaactttattcttccaactgtagatttttttggactctgtttcagtcttccatttttctatttttaaatgtccattctataaaggttttcattttttccatccaaattctttgaaacaatggggcatctttgtctctttgattgggatcagttggtgaacttgacattctaaaaggcttgggactctgcattacctagacacagccttaaacttgcctctttcagcctcaggcacctggatgtgatgttcacgggtcatagaccatttcagcttccttcatcacccttgaaaaccaccagaaatacaatctccacacctgtataaaagaaaaatgttagcagatatttgaaagccttacatggatgtgttctggtttgccccaggaggcacagctaacacctgagtgagaaaagcctagaaagacaaattgatttcaggttatcctcctagagaatctttaatcatcggagcaccccgacagtgggatggaggtaatgagcattccgttcccagaagcctcaaaacaaagtgaggtattgttctccggaatgtgacagaggggttcccgcagccgtgtgatcggaagaggcgtgctctagtcagtggtgctgtggttctgtgcatgatacaattctccaccactttcttcggcttcccagcgctctgtttggaagagtgccctgggatcccattgaaccagaaaccattttgataaagatcattttgctaaagatgagtcttcaccatgtggagcactggctgtaaacaggaaccttgaaataaccctttctcactgggcagcatctgtcggtgtttggagtaagactcttcagtttgtcttctcaactgaaggaaaacctaggaagtttgaagtgtatttacagaactataaaaatgataaaattgaaaatgtaaaaagtctatagaaacagatattttaagttgaataaaataagtaatccttaatagttttcagcactgagcagttactgtatacatgactattcaagcaagtattctctgttcttctggaggaaaaattataagggaaattataacctataggttatgagtagtgtgtcttctctctgaactccttagcgctataccaagatacaatccaagttcttgaaattctatcaaatccacaaaatatgtaataaaaggattacatatgggattctgcatgagaatttggagttagatattaggaagatcttcctaactagataaactaaaatgtaagtaattttagaaaagggaggggtaaatttcaaaggaagagtctaggtctgtgattctggaataagtggaatagaccaggacttcctaatcagtatttagtatcagtaattgttattgctagtattgtattaatagtataatcaattaaaaatattatccattggtattctttaaaaacaattaaaggttccatattcaaatacatttgagaactctagttaaacagataagtttcttgaagttcctgatattctcatgttggttacatagtacttcccaagtgggtattacaacatgtgattccaatctaattataatgaaactagaatttgttatttggattcatgctcaacatattcttatgtgtgtatctcaaaggcagctagtgtaacttgtttatatgaaccaactcaacttttcattaaaaagactatcataaaattgttttagtgtaaaccaactgtccaattactagatatctgtcatttatttcagtatatgtttcatttgcaataaaattttggtatattgggttaccactgcactaaaaaaaaaaaaaaatcctactatcccacatttcgtcaggataattataatctcttcaatctctgcttctctttgttgcctgcccaaagatactggacttggaagtcaaataatcataggttcaagggctcattccgatgctcaccagctatgtttgcttgagtaacccactaaaccttatgcactgcatcttggagccatcttcctgggtgaccctgggcttctgtttctcagtggtgaagggcgacccaatgaatgtcagctctcctacacttccagggtatatgtgtttgagcacagagtagttccgtatgtatacccagggccagatttaaggctctatccaatttcattggaatggagttgatggatgcctacatgaaatcagctgtcttggcagtggctcaagtagaagtgagtaagagctttccagcacagcatgggtggtaagagaaatgaggaaacagatcattaaggagtttagacacaaatagtacagcaacatcctgagaataagagttgaaggaaagatgtttaagtttaatttttagaatatgcattgggtatctcttcttctcatttattcagactaattgcaatgttatatcatttcccagttgtttggcatagactaatttaatttgtccatttttatattgtcagatactcaaagacagggacaggtctttttatctcctatctgtccccacctcagaggacccagcacagggtgatctgcgtacatttagtactgagcaaatatatttgtggtgtgtgtatattctctccgaaccccttagcgctataccaagatacaatccaagttcttgaaattctatcaaatccacaaaatatgtaataaaaggaaaatacctcagttgtgaaatatcctaataacgttccatgtttattctagaaatgtgggatcatgctaattagcatgctttttcctactaaactcttctaatattactaaatgtatagcttggctagcatccttgaacatacacaagttagctcatcttaactatgccaaccctatgtttttttgagagctttaaaagtagcctttaaaaaggtgtttgaaatatcaattatcaagtaaatttgagaaacagcaaacccaattttccactttttcaagcctcagacacctataggttataagtagtgcatctggaatgttgaaaataataaacagtattgtgtttgtatttatgtggcaccagcattatagtttgcaatgtgtgcttatttacaccaccttattttatctcaaaagatcattcctgctccaaagagacaacatgtgctaaatgagttttattttattttatacataaaatttcataacatttctcagtgtacacttcctgaatattctcttgaaattaagttagacattggagaaatagcaattttttatttttaatttgaaaactgtattaactatactaataaagaaaaattgccttaaaacaaatgtatctaattagagcagccatgcttttttatattgagatatatttgacaaatatgaaacatttccaaatctctttggggagagggaaaaagaatgtaaaatgcattatctaagatcatttaaaaatattaatactttttcctactaaactattttaatattactaaatgtatagcttggctagcatccttgaacatacacaaattagctcatcttaactatgccaaccctatgtattattgagagcctaaaaagtagcctagtattaatatcttagatcatttaaaaatattaatttcaaagacctaagagaaaaatattcttccttgaagaatcatttctgaaagagtcactgaagatttgtgaggaatttcattgcaatatttaaaggagttagttgaaatgattgttcttagtcagatcattgccagtggaacatcattctggtccaaatgaaattctgtccaaaatctggtcagattttaagatttttttcctaaaatcccaatcacacagtcattcagtcagtaaaatgggttgatacactgatctgtttataaactgttcatataactgaaacacataaaccaatccgttttagttacttgccactgcatagcaaattatccccaaacatagcagcttaagacaaacaacatgtatcatcccagtttctgctggtcggaaatctgggctcaagttagcaggatccttgcactcagggtcttctataaagaagactgtggtcaaggtgacatccgggctgcagttgcatctgagagctcacctggggaggagtctgcttccaagctcagggcatgggtgttgacagggcccaaatgccatccttagagatgggttctgctcagtcctgagagaagatggtttgctgctgagcttttcatggcaggaattggaagcagttttcatatttgataaatttctactattttcctgccatcgtggtgagttgatagagcccattttgctctctaagggactgtgaaatttataattcatataaagcttgaagaacaccctgatgtggataatcctgatcaaacctgcttggtgaggtgaaccccaactatatcccagaatcttctatgcacccatctggtcgagttacctatttatctatatcttaattaattttaaaaaataacttgaggctttataaatgtaatataagggattgggctataaattattgaacccatattgtggactaaattataactgctggaaatcaattcaggtaattctgagtatatgagtttctttttttttcttttcttttttttttttttttttttttttttggtggtgtctcactctgttgcccaggctggagtgcagtggcgtgatctcgactcactgcaacctccccatcccaggttcaagagattctcctacctcagccttctgagtagctagcattacaggcacccgccaccacacatggctaattttttttttttttgagacagagtctcactctgtcacctaggctggagtgcagtggcacgatctcagctcactgcaacctccacctcccaggttcaagtgattcgcctccctcagcctcccaagtagctgggattatgggcacgcaccaccacacctggctaatttttgtatttttggtatagacagggtttcaccatgttggttaggctggtctcaaactccttacctcatttgatccacccgcctcggcctcccaaaatgctggggttacaggggtgagccaccacacctggccaattctgagtatatgagtttctttgttgcaagaaatatagctattgttataatatggttctgatgtttactgccatcccttcttcattacaagaagggatgaaatcttcgtccaggagtggctaagggaattgtgtttcttgattctcgtgctcttggactggttctttctgcactgtctacagagcctttcctgggcccacctctgggaaccagttgatccaagcgttttctgctggacgaaggccttgcacattctcatgtgtgggggctgctatcagaattgcagggagctctctgtctccctctgcagtggcctcagagggcaaactgaagagcagggcctgcgtgtgccatttctaccacacctgccgccctttctgcatcagcccagtagctgctgcagcagcaggaggcgagtctcaccttcagcacgttctccttctgagaaggcagtggatgaacagcctgtccaccacccactgagaccagaagctgccccttcactgcctggaagtgcatcctgcacccatcagcatcactccaagcccttttatcccgggatgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttaagtagaaggagcgtaacagtggctaggcatcactccataatctagctctccacctgagcaacacgtgcagagcttcaagaggctctgaattctttctggctgccagagataaccaattatacaaagaagaaaaatctgccaggtgcagtggctcatgcctgtaatcccagcactttgggaggccaaggtgggcagatcacctgaggtcaggagttcgagaccagcctggccaacatggcgaaaccccatctctactaaaaatacaaaaattagccaggcatggtggtgggcgcctataatcacagctactcaggagaccgagacaggagaatcgcttgaacccgggaggcagaggtggcagtgagctgagattgtgccactgcactaccgcctgggcaacaagagcaaaactccgtctcaaaataaaaaagaaaagaaaaagaaaaatcttatgttttcttactcttggaatgaagaaatatgcaagtacgaaaattcatgaggagattcggtaggtatctagctctgattaaatgatttattagaaataagaattagtgaaatcaaccactttttaagttacaaaatattacaatgatcagttttaacctcaccccctgccctgaatgaactaattgtttttcttagagccaggtaagggcctgccattggcaagcttgcaccttgagttagggttagagttgtcatgagtcaaatgccagccatgtcctcttctgccccccatgggggggcccaaagtgcaggagtgacagagaggaacagaggcagatgggcagcagggagatggactggcaggtacctgtgtcctcacaggtaattacgtgtcattccctctggatggtttctgaactgtgggaactcccccatgtgcattgatgggagaagagccaggcagagacacggtaaggagggcaagttatccatgtgaccttagggatacttggggcaaaagtaggctaacctccgtgcacaccctggaacaaaatctttaaaagagagagcacagaagagagagagagagcactttgcccggaatgagccccataatcagacaccacatctcccaaattagcagcacccttggtttctgggcaggctgagtttcccgcgcgtcggaggggataggatgtagcggtgaataacagtaagactccaaaatcaagtgggtatgtctgacgatctgcctctctctcccccttacacacacacacacacacacacacatgcacacatactctccctcccccttacacacacacacatactctccctcccccttatacacacacacatgcacacacacattaacacacacacacattcattgctcttagtatatttcctccctacctccttaactttgaccattgacaaatttttctctcttaagaagtcttgaggcagtgcactcgggcataactcccttccttgtgatacatccacgtctttgtgaatgatgaatggaacgttgctcacttgttagtaattccaacagacaaagacgtggcctgagactgcccctcacctgctctataatggcttcttgcagcctgctttcctccctccagcgctgccgttagagcctgaggggtccaagggagtcagtctgcccccgtgagtcttcatgtggtgtagatgatgtcagggtcagaaactgacattcaacacgagctgaggcccatggtcccaaaaatgtgtgtgagctgtagttgtccaaagacgtgagaggacaagaggcttgagtcagggaaggccgacggagaagaaagcctggaaggagaggaggatccggggtgaagaagagaggaatggggagaaccttcccggtgcgatcactgcagaggaacagaggccgccatgggaaacacctgcagcgagcatcagcgaggagctgaaagtgctcaggtatcaaaagaaggcagaagaaagagcagcaaaaaggagagaaaagtcaacataaaaatttaacacgggtcccttctgctgacagaagccttcccagtgcctattgcggccaccttcctaatgtgacctcagatccaaatttagaaacagcctctgttccctccgctcccagactgttttttctgcttgccctgcattcatttcttggaagttttttaagtatataagagcccaggttggccagggcaggggttagggaagcaaaggaactggaaacctgtgtccgctgaattgcagagcaggaataagggactctgcagaaaagagcatgacaaagagccgcggatacaagcgagggtagcaggagaaagagctaagaaggcagaggttagttgtttgatcgtgcacttggggaaggtggagggagaaggggccgtgaagagatggaacggactggcagaggagatttgtgtggggaaaaggagacagaggggacaggaagaaggggacagaagagtaaagagcctggaagggccagggaaccctgcctgccatggtcctcccccacttcctcccacacaccctgatgcaactgtgactgccctggcacctcagcagcttcagaacagggaaaggaggagaacacgggtttcacaggaggagaagcaaggaggacccagggagctggggtgccctgtgattctcaaccctgtccacatgatctgacctgggggatgagagcttattagatccaacttgagttgacaacaaagaacttctggagcctttcaggcccttttgaaacaggcagatcttctctgcagtcatgtctaatgcagcaaagaaaacaacagtgtcccctgcaggtgcagggacttctggcctgagacagcagaataatcgctcctggagtgggaaggttggcttgtgtattgtgcgcggccatcagcagcatctcatttcagactctctcatatccccggaatgtcccggggttaccgaaaaggccccattctccttccacctgccttctcctgctgctagaaaccaggatttttgactattgtccctgcatccccacatgtcacccagaggcagccttaggccccctgtcctgggccacccttggcataactggagtagacccgggtgcctaccacagcctccttttcctcaagggcagctgccctctcggtgccctgctcactgtgagcaaatacatatttaaagacatattctgctacttcccaaagggaccagccaccacctgcactcctcgtcctggtggaaacagtctgagtgcttgctttggtaatcaaaggtttcattgagtgcagatgtagtgatcctggcaaaaccctggaaacagaaagtcagctgaaggggtgtttctggagatgaggaattgtgctggttagccacgggcatgtcctgaggataattatttgtttacaacatttctgtgaacaaagaacatatagggacagaaataagttagtttccaagaatcttgtgatgggctccatttatctgacccattgggtttgtagaagaggacagaatgctgctttggttctcctccttggacagtggaactagagaacgggaagctgagatggccgagctgagtggacagaggagggaggaagcccctcacctcgcctgcttcccacagggtcccttcctcctcctcctgtttcctaagcttctcagctgggcttcagatgtcaaggtttcctggcttctgccacttcaccttctcatcttagctgccactggaccataagcatttcaggttgctcagatctctcccaccgcaaaataaagcaaagacaaaaaagttctctctctctcaacccatacccatgtcctcctctggttcttcccttcacagtcaaatgactaaagaaagaagcagctgcactcacctctctgtcccctccccactcactcttccgtgtgtctcccacagagtggaatgagtgctcagggctcagccacccagcccctggggaacagtatgagtgtcttccccatgttatacccccgggggaaggtatgagtgtcttccccatgttatccattaggagacgggctttgggagattgcaaggtttctgcagtgccagggatggagggctgtggttccaggtattcctctctgcaaacacctgctcttgatgggggctctgctgcccctgagcccactggtaactgtacttggcccccaccacacagcaaaactctcacccatcttaccagcagtcttctcgccctggaattcactggtgcctgttttaggctgcctgggctgccatggcaaaataccacagactgggcagcttaaacaacagacgtgtgtatctcagagttctggaggctggaagtacaaggtcaaggtgccagcaggtcggtttctggtgacggctcacctcttgtgtaattttgggtggacacaaacattcggtctatgtgccaatctcctcaggcctcctgtggcagaatttgaggccgctcacccctccctcttcctcagtccttggttccacaggccctggctgccctctggctgcctcctggccacttaggaggtcctcaggtgctcagacttgattggatttcccagtcccacccaaggtcatcttctcttctcttgcgcactcaccctgggcaacttaacctactacggcaactactgcatcggctgctgccacccaaaacgcgatacactgagtggtggcagaagcctccccaggaagcctgttagaaacactgactcgggacccagcccacaccctgatcagtcagaagcctcgcgtggaggagatctgcatatgattcgtgcgcacactgctgagacacatgaacctcaacaacaaggctcccgcatcacatctctgttctggacctctgactcgggtgtcagacctgtgtgctgctgtctccggggaacgtagagggccctcagacacagtgtgtgcaactgatctcatccgtttaatcccacgttggccccacgtcctgcctgcaacatcagcactttaggaaaaacaccattgtcccctccttaccaggaccctggctagagaccttctgtctccctggcccaggcagcatcgccatccccctgcctttgggatatgtcccttccacttccccattgccactgcccagttcagcccaccttacctgttatctaaaaaaccacctctgcctccagggcctctttgcctcagcctccccgccccacacttcttcaatctgtgctggccacgctgccttcagggtgacctttctcagtgccaatcaggtaactcattcccaatctgcacctcttccctaacccccttgctgtcccacctgctccttccctctcacctctgggcctttgcaggcgctgttccctctgctgggagcacctgcctcctccactgacctcacagttctcccacgcccttccagcctcttcagcagcaggccttggactccacaggagtgggctcccatacccgtgcacacccacggggaccacagcactgctgacggttttccgatttcctgcctatgagtccccgcactccaagggactttgagatgcttaaaggtggcttgggacatggctgatccacaatagagcctcgagaaatatccgacccattgcaaaatggaccgtcccccacccccatgcggtttcagggccgctcccaggctgtgagtgtttatgtgaaaggagtgtttgccacgtcgctcgggacgcccatcctggcaatgagcagctgcagcttccaggattttaccttcttaaatgcacttctgttaagctgtgcatgtaagaggtctgttctgttgaaatatttcccagagactttcatactaaggagggctttattgttataaatatttaaacctgctttgcagccagtcgctacgattactcagctcagaaagcatgcacaaagcctgcctctagtggacgatcctgtgctattcatcggcctctcattttaaatgtcttcctgatttcaatttaaaagcgtatctttatataacatatacaatttaactttttctttttaaaaatatgtatagctagtttttgttgtgcaattctatgagctttaagacctggatagacttttgtaaccatcaccacaaattgggatatggaacagccccatcaccccaaaaaactccccctgctctgcttccttcagggcaagccctccctccacccctagtccctggcagccacagacctgtctacagtcttgtagtttagccttttctagaaggtcatataaatggcatcaagcagtatataaagactagcttcaaagtggagaaaactttaggcctctaaggcattttaatgcccgcatagtcttcatctttagggtaattttgctctaaaaacgtttttgctgttttggtgaaatatgtaatactaggatagactatggaagatgtgcttactgagttcttaccctcaatgtcaaaaacccaacagactttcattactgcatcccctctgtacaggatcaaagtgcccacccttagaaagtctgatgagacagagaagaatgacttgcgaggatcaagaaagacaggctgagtgagcagtgtcctggcctgaagcctctgagcactgcggttgtccctcagcacccctggggagtggttaccagaacccccgtgggtaccaaactccacagaagctcaagcgccttaggtaaaatagtgtagtatttccctataacctacacacatccttccgtgtacttgaaatcatctctaggttacttgtagaatcaaatacaatgtaaatgctatgtaaaaagttgttctactgtattgcttaggaaataatgacaagaaaaaatctgcacatgttcagtacagatgcacccatccttttctttcttcccgaatctttttgatccttggtggttgaatttgtggatacagatctcacaatactcagggccgactgtaattctgaaggagggggctttggggcgggagcctacaggaagctggaggcagggcactggggacttgaaagtgaaaaagtcagtcatgagcatgggagaaaggagaggaaggcaggggaaggcactccagatgaaagaaccccctaagtgcaggcttgaggtgggatggcacagtgagggcaggagagggatgatagatggtccacctggagcacagtatatgcagtggaggggcaagcaggcaggccaaggtggggctgagtgtctggagttgaccctcgttgccaccgtcttggagggagctgaatggttccagagtagaggctgatgccacgtgaccaggtgaggtgtcttgttgagaccgggcacagtgattcatgcccataatctcagcactttaggaggctgaggcaggaggattatttgaccttaaaaaaaattgttctgttgaacttattgccttgagacagaggagctttcccaggatggccatttcctacctgccggcctcagctcccatcgcctgcccttatgcccactaaacgcgcttgtccaatctcatggttaaggagccacgggttatggttttggccccatagatgagggagaaatttgctggagggcctgtgggagtctttggctctcttgcaagaggaatacagagttggcctttctcttccccactgtccttgccttcatgaagctgtgctgcccaggctgtcacggtgggacacggagcccagcccctgatggcaccatccatgtgttgctctcgatccctgttctctagattagctaagccagaaaaattagcctgatttgtctaagcgtctgcccatcgggttttcccttacttgccactaaacgagtcctgagtggctttgctcgtgctgtttcctccacctggatctccttctctaccttgtccagctggtgatctcttccatccagaaatttaacttcagtctgagtgagcacctccccagataccccaggcatcaaacacaatcattgcttacagggctgtgtccctcatcaaggagctgtgagcccctcatgagcaggaactgctccttacttctctttgcacctggaaggtcataaatgatcagcaaatattcgttggataaatgaaagaacaaatgaattccatagaaacaagcaagggaaaaatgggaaatgatttcatcaattcttgctaagtcacaggctttcttccttcacaaaaggatgcgcaagagagttgaggatcttgagtctgacaagcagagaggtgcttcttgttgtatttatcaaagcttcgctattaatccctgcagggtcagtgaacgcatgtcagctctgcactcagtcctgctgcacttcggtggactctcaccagaggtcaaaggctatcagctcactccttttgtctgaccaatgccttgggtggctgctctcatcctgacttgagctaaattgggtgatctgcctggagacttagaaccttattcctccccccaaccattcccactgcctttgccttgatctggactcttctctcctcttgccaggaccaatgctgccgctttccacctgtccttccctcctgtgcatcccacacagcctgcagctaagcatggttctgagcaagacacagcttcatgcaaaatattgtacctctgcttgaagacccaatgtgaacattgcccattgatttttgtttctcgatccccaacttcccatgccccaaaatagcatcctgggaccatagaaatggaattgagctttctaaaatgattctgcccatctcccactttacagatgaagaaagtgaagtccaggaagttgacattgcctcattcaaaatcatgtgactcattagcagtaagtcaagcctgtagcccagcttgtcaccagggctgttttcttcattacatcaccatgtctcttcctcttcactgcctgcgtgactatgtctcggcagtcaatggatacagcacagcattgccagcttgccatgtacaagggggacctgtttcagatattccatggagaccctggctggaggattgcaggagagtcccaggaggcaggactgccaatggcaccaggcttcgcagccatgcacctgcagccctcaggcagcactgtccattgtcatacgagtgtggcaggtgtgaggcatcgcatctgctcaccccggggataatgcacagcagctacaggcagatttcgggccagagagcaaccgagtgagccttgcagcctctgctgccagcacaggcttgttccttcaacactggtggagagagacacgctgtcatcaggcccaagaaatactgccttccccatcctatccctggtcactgggtgcccgcagagtgtcccagaggagggagggagggaccctccactggttcaaatggcctgttctcagagatgcagcaatggaccctcgtgaatactgaactgataatcatgggaaggagactggctctcctggattccctcatgattcctctgagtgacaatgtgatgttggccgactgtgtcttcttcagaatatcatatacacttgaggtctccaggagcctccaattacattattttcctggctcatacagtgacaagtaattcttatcctggattcctcgttactgagacttttcttgccttttttgttagcttatgatttattctaggacttcctccaacaggttatacttaactgtctacctcagtctctggaagttttaaaaatgttcagctaaataaaagaagtagattctccctggaaaccaaatacctatgggcctcactgaattaataatttatttatttctaaaaaaaggttttattaattaagtcaaaatttcattgtaattttaaaataatcttgtggtctttctccatgtgtctgaagcttgtaatcactcttattgtcctgtgaattctgatatgcagttacctgctagcttagtgggtaaacattttctctattaatgagcaggaggcttattaaactgtgacagtttagactattctttcaaggccattgatcagtgaaaaaacagaatctggatgctaaaaactgtgcccatgtgaattaatttacccccatctttccctgagccatcacctgagtatttgttcctaggtttgttggctgcatttgcttaatttttatcttgtgatttcattgagaggtgtagttgagtgggtgtacttacagcttctgttcctgtttgaaatatcatttggaaacctgatcacaccctgcacaagtatgcttgtgaggcatactaattcaataccatttgagcaggtgcctcctaacgctgccctcctcaacctttctcagcatgaatgtacgctttttcatgtgctgattttaacataatctttggttcacagtaacagagaattttgtttgaaaaaattcagggattgaagggatattgacatgtacctagtcaccatctatcactccatctcaggagcaagtgttccttgctctcgtgactttgtcctggtgacacagaattcatccttgtagaccacttactttcttcccaggctgggcagttctggcttttgcaaagttcttcatcagctaatttaagtctgctttttaaaacttcccatctgctgaatctcattccaccttttatgcggcagtgtccactgcgctttctgcagtgacggaaatggtctacagttgcactggccaagatggtggcattacccacacgtggctcttgagcatggggaatgtggctggtctgacaaaggaactcaatttgtagttttctttaattgtaatcaacttaaaattacataggccatatgtagctagtggctaccctattgggcagtacagttctaaagcaatgctgaatatttaacgaccttcagatatttgcagacagctctcctatccacatctttagccttctttggcccagccgaacaagtgtttcagatcatgcctctggactcctttctgtctccggacttcgtaacagcatggtcacccttcattcacctcattagatatctgaagtaatgacggaagtaatcgattgagtaaattagtgaatgaatatgtgattttaattcttcacataaacctcatcctagctaatcctcttgtcttctttataagctgaggtttttggttttatgactgtggatgggaagaggggatgcagaggataggaccaagcaaggtcgtattttctttaataaccacatccccacctgtttcccagttgggaaaaacacaaaccgatttgctctcgggtaccactagtttattataataagatgtacaaagcaaggcagatgaccctgcagtgatagcagggatggtcacttgtttggcagaatggcccaggggagcatctctagccgtttcaatcccaagaaagcaccttggggtagagatgatgcaaaaccaacctgtacatcgaaatctattttttattattcaaaaattacaacctggtcttctgaaacttatttttttatgcttttacatctcctacagccttacacataatttctagtgtctttttagaacctctcagtattgtaacatttaatgcgttctcagcagcgggtaggtccgtgttatgtttgcatttgaagtagaagagctaagctaaaaaatatgcctttgtttactaataaggtagatactatttttttgttgctgttgtttgatatggagtttaactcttgttgcccaggctggagtgcaatggctcaatcgtggctcactgaaacctccacctcccaggttcaaacaattctcctgcctcagcctctcgagtagctgggattacaggcatgtgccaccacacccggctaattttgtatgtttagtagagacggggtttctccatgttggtcaggctggtctcgaactcccgacctcaggtgatccgctcaccttggcctcccaaagtgctgaaattacaggcatgagccaccacgcccagccgatactattttttactcaaaccaaaaaatatattctgcgagtaagtgatccactgtatctcagcccataatgatggcctcgacaaggaatgagatggccacagtcagtgtcacccactggaccacagtgatgggcgtggtgaaccaagaagtgtggacatggcactgtgctgggttacagtagtgagggaagcaagcttagactagggagcaaaatcaacctgtgatgagttgtgccttcctttaagcatcttggcatttgttgttggcattgaggttatagaccggtggtgcaaagacgaggccacaagggccactggagaagagggaggagagcccaatggctagaatctggaaggacagccacacgtttccccctctgattctttaattcacccacaacatatgcccatggtgagttcttcaattgcaggcttttggtacaggaaatgagctcttgctagagatttaagacggagtcaaatcatgggtctagccctaatgatgagtaactgatggtgaggatgagagttgtgacagtgctggtggtcatgaggaggatgaggatgatgaagaagaaaacagcagtaacaaggacgatgatgaaaacctgctaattatggtgctgatgccagggataattatggtagtgataatgatcatgatcccaggaggacttactgtcattatttctcagtggcttttctttgggtagagagtgagataattaaagtctggaaggagacaggaacagggggcgtgcagttcctcagatccatgggtcccgcccagctgcatgctgggagtgaaactatcaagattaagagctatgctgtttcagcagcatttccactgtctaaatataaacagcctcaggccctgatccagcagaggagaccacagctgccaaatgcatcgccagctgcaggccctggctgggtttctttaggggaaaaggccatcccaccatggacaggttccaaaaggcatgagcctgcgaatagaatttgaggttcaaggaatgctagactgtgcgtctgtgttcagggtcacagagcgagtctgaagggagcaggatgaggacatgggtgccctgcctccagggcctgtgctctctgctggtacagacaagggcctggtgagatggtagaacaggggcggctactgcagtggtgccacctgcgtaggaagacgggaatctagtggggatgggcaggggccaggctccctttgctttcgcaggcacccagctccagtggcccctcagtcccagctacagatggactttgagatctgatgacaggatctgctgttatcccacctctggatcaacggcgccatcatcggtgccccagctagccagcagatgtgggccagagtaaggcttgactggtccacatgtcctttctggcttaagacactgcttatcttgactcagggagagaaggaaatggaagaagaagaagaaagaagatgcatttaaaacatattaccaaactaatgccatgaacacatgaaatgtcagccttttgattccctcctgccaatacgcatccgtttatccagtgctgacttactcagccctgaacatgcaccaggcgctctcgcaggcacagggaatactgtggtggacagagccggggaagcccctgcgctcgtggatcttacatcctgctggaaagaccgtgcataaatagatgtgtttatcatgtgtcaggcaggacacgtgctccacaggaaagtgacgtaaggtaaaggacagggagcaaaggggagtgtctgggggaggacggcagggacggcagggacggcatggaagcagtggcccagcagacgcaggacaaggtcctgtgatccgaggaggggtctcagggtggagggacagggagcaggccagcgtggctacagtgcatgatgtccaggatgagcaaacggagtgatgtttgaacatgtcatccgggaaaactacacacaggggcaggctcacagccactttttccccagctgatcttgcttcctctgttaccaaaccaccctcaatacagcctcgcaaactgagcaacagaggagggggaacacaactaataccccatttggcaggctggctgaaggctgttgaagaaacagcagaaacacctggtaatccttgcaggcgtcacccaggctgcgggccggagctgtcatgggacaagcaggaggctggaatggagctgggatgggaaggaacacaggccatcagcttcccaggccccacgttaattgtgtaatatcatcacagcagggtaggatgccctgtgagggcacctaacaggtgttcatcacattcatcagcattgccctaccaacgaccgtatttacatcaggcataaatgcagtttaccgcactctgtgagaactggggattaatagctccggtccagctagattctgatttccttggtaggaggaggcagaacagcacacatcttgactgaataatcgtgcattttgcatggttaataattctgagagcaggaaagctaccttcctaggatcacagagagcttactttcttttctacgaatctttgaaaaaccaaacagatgggattttaccttaagagttagattgcactcttacactgtgctgttcaaattatgaattggcctcacttggatgttggactattgattatcaactctggcaagctctttattcagaatcttaggacatgcacattaaaagaaaaaatcctctctttgacctggttgccaccaatgtgtatctacataggatgaaaaaatgcatcacgtactcagaagaacgggctgcagccccggagccccagtccttctgccagctctggagcagggggagctcctggctgcacctgaggtgtcagtctccaagaacctgagccctttccacacgcatggctctgttctaggcactcgggggagctcaaacagaaagagagtaaacctgctgctgttcagtcagagacccaagtcatactcacaaatgatcaagctagtgaactggatggcattttcacagctagatcttgtactgcaattatagattgtcaccataaagcttttgagagcaatttaatagttaataacatcctaattctatgatgtgagtaatctgtgctctgagaacggcctacatataggcagaagaaccatgaggagctctcaaagaaaatgtgccatatattcaggcacctggggagtggttgtagaaagtgtgaccttccaaggcaattgattttggttgttctttaaaggatcactctagcagtccggtcattcttatgggtcctctggtctagatgcccctcatggaggatcttctaatcttgcattattagaaatggcagctaagtggattatggatggaaactttcatgttgtaaaaacacaccaccagaagtcaaccattcttattttgcccacgtattaatgctatttccaaaactgcccgacagctcacgggtgtaggggtttaggggtctatattccttgttagactcaagctccttgaaggtagggaatgtgtcttactcattactgtatcctcagtttcttgccccattgtgcaagctaaataaacaatgaatgaatcaatgaatcaatgatgaataaaaggaaattagttaaattccccttagatagcaataattgtccttctcaccccaggttatctacagccagataccatttggattattgaattcctaggatgttccttgcctctctgattgtttgccatctaatcatatccactcttatgtttttatttaacttcttagtatacatacctgattcccacctttaagtatcctaaaggaacacaatgccttatcttgctttccctccgcccttggcacacaccacctaccacaacgttgaacttacagtaaacgatcaaggacaagtttcggactaatgcatttggatggaatggcttctgtggctttcaaacagaattctagatctgacctagaccagacccagatcctgcctggatgtcaggacttccctgtctctagagaggcagcatgaacagagacacaatgccgggcggattgttctgacctggctcccagacccaggccaggggccagggtgtgtgtataagggcatttgtattctgatggcctttgtgggttttttaaaccccaattgtatcattgattttttttttggcattgacgttaagattttcattcaatggtgatggattttaaaattgccctgccatgtggggtgttactaaagctcatgtggatgaaggctgttgaacgcctgtgtctgtgctcacactggctgctttgctttcctttcctgcctgacacgtcctctccatcttccccttctccgttgccatcttcctgcccttgtctcctgccagcttcctccttttctgcactcagccttaccctttcttccccttatgcttcctttctgggactcccaaacccaactgtgctttagagaaagagtcctggactcaacgccagggaaatgcatgcccgtgttcctgccttgctgccttctactctgaccttgagaaggttatgaactcttgggcttccattttgccatctctcaagccagtgagttagaccatggatgaaagaccgcccatcctaggattataaactgggtaagatttgcatcaatgtgagtcttcacactgatgctggctccaggtttcctttctccactgtgagctgagttaaaaactctctattaggaggcatttcacataccattgtcgaggaggtgggaaataacaattccattcatttgccaagtagaaaagcccttgccttcttggttcattcagcagagggaaaagtaagctaggcggaggcaggaatggcctttatttgcaaaggaggctgtgcctcactgttcttcaacaggatgcctaatgagttagaatttgagtagcatggctgggtgcagtggctcacgcctgtaatcccagtactttaggaggctgaggcgggcagatcacaaggtcaggagtttgagaccagcctggccaacatggtgaaaccctgtttctactaaaaatacaaaaaaattagccaggcatggtggcaggcacctataatcccagctactcaggaggctgaggcaggagaatcgcttgaacccaggaggcagaggttacagtgagccaagatgtgccgctacactcctgcctgggtgacagagcgagacgccatctcaaaaaaagaaaggttatgcctcacaggttctgacattcagtaggatttgcactttggtgcatttttctttgtacataaaaccctcatctcacttttagaacagtgcagtacttaactttttccaggattaggtattcatttcagtcatgaaaaagaaaagggcatttgacccaaattacaaaaactattgaagtaaaactgccctattttttccttcatgctttcattgcaaaatgcagtgactgtctgctgctggatgagtgtgtatttgggggctctgagggatggagaaggagaggcacgactcgcaagtgccaggaattcacattccgctgacgcgggaacacgggcagtgtatagacattgtacagacattgtaaagacattagagcacaattttgagaaaacgtgaaaggatttccacaagtctttatgtcctctgtatattaaggtgttaagacaatggatagcaagagaaagatgggattttgtggcagaaacttccaaaaaaaaaagttgacatggagcaggtcctcaaagcaggaggcctcagagtactttgtagtttaagtaggagggaggactcgggtatctggagatgggaatggaattaccagaggagaggagcattgaagaaatggcgtcaacactgaagaatgtgctgctttataagaataatgagcccttaaatgccagtctgaatcttagcttgacaaatgaggcgaatctgaacacctttgggataataatagcgccttgctctatttgagataaaatccatttcttctgacttctgaaaggaattattgtattggtccatttgttttattttaggaaattttaaaatatgaggtagaaaagtataaagtattctccaagttattagctaataattggctgatgtcacccaggtggttatataataaactgtctcagtatcattaaattctagaagtccagaagaagaagtcaaggacttcttagtattttgaggcagagggaagaactacaaaaaaacctcagggcaggaaaattggacctgttgcaggccctgaaagctggtgtgatttgagtacagtgagagagagacacagagacagagagggagagaagacagagagagagagggtggggagacagagaaggagagaagacagaggggagacagagagagacagtgggggccagtaggggaatggaagcacaattgtgggttggtgtctcctggctcaatgcctaatgagttagaatttgagtagcatggctgggcaccgtggctcatgcctgtaatcccagcactttgggaggccgaggcaggcagatcacagggtcaggagatcgagaccatcctggctaacacagtgaaaccccgtctctactaaaaaaagaaaaaaatacaaaaagttagccaggcgtggtggcaggcacctgtagtcccagctactcaggaggctgaggcaggagaattgcttgaatccaggaggcagaggttgcagtgagccaagatcgtgccactgcactccagcccgggagacagagtgagactccataaaaaaaaaaaaattgagtagtatattactttgctagggctgtcgtaacaaagtgctacagactgggcgtcttcaacaatgaaaatgtattgtctcacggttctggaggccagaagtcagagatcgaggtgtctgcagggtgggctcctgctgaggctgtgagggagtgctggctccaggcctccttcctgcatctggtggttttctggcaatctttggtgttcccaggtgcaccaatgcatctccagcctctgccttcgtcttcacatggtgctctccttgtgtgcatgtctgtctctgtgtccacattttccctgtttacaccgacaccagtcatttggataaggatcttttttaatgacctcattttaacttgatcacccctgcaaaggctccacctcccaataaagtccctttctaagtcctgaggataacgactccaacatgtcttttctaggagacacaattcaacacatagaaaacagttaagaaaaaaaagagaaaatttggtaattgtcttctgtacagacttctattaaaacaatgaaatgtttatttaccaaaatcaggaccaagttacaggccagtattaatatatgaaactgcttgcgtttcacatgtacacttaaatttccagtcctgattttcataccaagaaacatggccaagtcatcacttcataaaggaaaaccgttttggaaggtaaaaaagacaattactgtttgaaacagtctaacattgaactttagatgtaaactatgccgagcaaacattttttccaggtaacgttatttgttgcagacagcctttggccattgtgtagatcccaaatgtggtgaaatgggagctcccagatcattgcccagtttccagctgccatcccgagtttgttggtgtcactgattccaagaacaaaacactggtgcatgaaattaacaaccttataaatagatgacagcacgtctgttagacaaaaggctgcagttatcccctagaaacaatcaaacacaattccagtaaaagtcttgccaaatacctctttgtaattcaaggaacctaacaacagacaatatgcagtgcctccttgtttatgttctggaactcagcgctgctgcagtgtaactgagaacaggctagtacaacccacaggcatcttgaagtgtgcaaggaggctcagagaggtttatagcattgttgttttgttttgtttttcatggttctttatgtcattgtttgttttataaagtgttatttatagtatgttcatccttagggacttttccttgaaaccaccacctttaatgctgatgattggtgttcccatggaccttgggttaagggggccaaatggtatagatgccctggggagagcttgctattggcctttgggagagaccctgcagcagtaggtttcagctctcccagtggcagagctgggtgataactgcactttcttctaagggcgatacattttgggaatgtgcgtggtgtgagttttctgccagcatctttatagagcaatgtgtacttgcaaataaatacaaccaaagtcaacaaaagagcatattgatgctttggtagagaactcagcagtctcccctctctgtagcgtaaaatccagggaaaacaaaggccccacaatggggacagatggccccgcataggtctaaggactgccattccgttttaaagttataaagtactctcacactgtttacctcttttatttcacaaaaccaccgcattaagtggacagggtagaagatattatcctcactttttatatggagaaaacgtggctcaggtgacgaggtgaatatttgtgggtaaggcaagaactttctttctttctcagtcagttctctctactcaagtggacttctttttattattattattattattattattatcattatactttaagttctagggtacatgtgcacaacgtgcaggtttgttacatatgtatacatgttacatatgtatacatgttggtgtgctgcacccattaactcgtcatttacattaggtatatctcctaatgctatccctcccccagccccccaccccatgacaggccctggtgtgtgatgttccccaccctgtgtccaagtgttctcattgttcaattcccacctatgactgagaacatgcagtgtttgattttctgttcttgcgatagtttgctcagaatgatggtttccagcttcatctatgtcccttctaagctgaccccactccttcctttcatggtaggcacacatgcaccgagtaaaatggctgaatctgggctccaaaatgttctcttcagtcccgcatgttttggcaaactttcctctctgctgtggcacttcaatcccgctcttctccataaggtctatccttttcttcataaaactttctcatggatggctccagtcccaaataaagctatcctcctgctcctggcttactccaatttcccagctcttttgggaaatgtaaactttatggtgtcattattccttttatgtaacttccttttttcttttctgagatggagtctcactctgttgaccaggctggagtacagtggcacaatctcagctcactgcaacctctgcctcctgggttcaagcgattctcctgactcagcctcctgagtagctgggattacaggcacttgccaccgtgcccggctaatttttcgtattttttgtagacatggggtttcaccatgttggccaggctggtctcgaactcctgacctcaggtgatccacctgccttggcctccgaaagagctgggattacaggcgtgagccaccatgcccggcccttttatgtaatctcttatcctgtcccaaagacaattttataaaataataataagtagcacttttgggtgattaataggtgccaggcaccatgtcaaaaactttctgtccagtatctcctttaatcttcacaagaaacctattgtggtaactcttacaccattttatagatgatgaaaccaaggctaaaggaaatatgatgaaatgtccagggtcactcggctgggaatttgggaagccaagttggaaactcagatctactaattttcaaagcttgcacttattttaaagtaatggcatatttggtttgttgtcatagtttaatcatgaactgtttcaagtgtacagaaaagtacagatggcattacttaaaaccacttgcagccaggcgcagtggctcatgcctgtaatcccagcactttgggaggctgaggcaggtggatcacctgaggtcaggagtttgagaccagcctgaccaacatggagaaaccccatctctactaaaaatacaaaatttgccaggcgtggtggtacatgcctgtaatcccagctacttgggaggctgaggcaggagaatcgcttgaaccctggaggcggaggttgcggtgagccattggactccagcctgggcaacaagagcgaaactccatctcaagaaacaaaaacaaaaacaaaaaaccactcacatccagaatgctcaaatttaacaagtgtgatctgtcttgttgaatgcgtccagggtcttgaaggtgtgtatgtatgctgatgcacttggatgacctgttgtaaagtatgtcaattaggtcaaattagttgatattttgttccagtcttctatttaattacttttgctgtgaattactgtgtaagaagtattgaaatctctcattgtatttggagatttgtctagttctcttttcaaatctgtcacgttttgcttagtaaatattgaagctctcacagtaagcacatatacatttaggattttcttgtcttatcattgaattgaccttttcatcattatgaaatgtccctggtagtattcctttgtctctgttaatattctgtgttcttcagtccatttgtttgataataaaccattgcagctttcttttgattcatatttgcctggtagaactttttctatccttttacttctaacctcttcatatgtttacatttaaagtatgtttcttataaataacatgtagttaggtcttgctttttttttctttcagtgagacaatctctatcttttaaaaagaatatttagagaacagattagcaaattatggcccctgagcctaatttatcttagtgcctatttttgtaaataaagatttattggaaaacatccatgagcatttgttaggtattgtccaaggctgtttttgtacttccaaagtagttgcaatacagaccgtatggcttgaaaaaccaaaagcatttattatatgtccctttatggaaaatatgtgctgactcctattttaaatgttacatttgatgtaattgtcagcatgatttaattgaaatctaccatttgctattaggttggtgcaaaagtaattgtggttcttgccagtaaaagtaatacttgtttctttatgcttctctcttctgatttttggttcaatttttcctgtcctcttttggctacttgagtttcttattattccaatttattttcactgttggattaacaagctctttgttttactttttaatggttgatctatgtttacaatgggcatttttaagttatcacagtttatctttgattgatggaccacttttggtatatcgtgtaaaagcctacagcagtattcttccatcatttcaccataccatcctttctgatattttgttgttcatttcatttctacatatgtttaaatcccataatacattgttattatttgtagtttagaaaatcaactgtctttaagaaaaaaaacagctttatatttatctatttcttaattcttgtttgtttttgttttgttttgagatggagtctcgttctgttgcccaggctagagtgcaatggcacgatcttgtctcactgcaacctctgcctcccaggttcaggtgagtctcccgcctcagcctcccatttctcgagtagctgggattataggcacccaccatcatgcctggctaattttttgtgtgtgtgtttttgtagagacagggtttcaccatgttgaccagactggtctcgaactcctgacctcaggtgatctgtctgcctcggcctcccaaagttttgggattagaggtgtgagccagcatgcctggcctatttcttaattcttaatcctttttttttttttttgagacagggtcttactctgtcacccagcctggagtgcagtggtgcgatctctattcactgcaacctctgcctcccatcttaattcttttttatagaaacgaatttcctctggctttattttctttctgtctgaagaatttatttaacattgtaatgctggtctactggcaatgaattctctcaacttttgtttatctgaagaattatttcgctttcattttttaaagtttttttgctacataaagaatttcaggtggacattatttttctttcagtacttaactatatcattccttgtcttctggctagcttagtttctgaggggaactctattaccattctcatctttttttcctttgtgtatatgtttcttttctctcttgactcattcaagattttatctttatctttgattttcagcagtttgaatacaatgtgcatagatgtcattctctttgtatgtaatttgtttagagtttgtgaactttgcacatctgtttttggtagtcttccattcagccatgatttcttcatgtgtttcttctgtcccatcctctcttgtttttccttcggggtctactcttacatggatattcggccattttaatcattccaggctggctgtgtgcggtggttcatgcctgtaatcccagcactttgggaggccgaagtgggcagatcacctgaggtcaggagttcgagaccagcctggccaatgtggtgaaaccccatctctactaaaaatacaacaaaaattagccgagctaataatcccagctactcgggaggctgaggcaggagaattgcttgaaaccaggaggtggaggttgcaatgagccaagattgtgccactggactccagcctgggtgacgagagtgaaactctgtctcaaaaaaaaaaaaaaaaaaaaaaaaaaattatttcaggctctggactctctgttcttcttttatttacttatttactttttcttcttttctcataaatataatgttaagaagtagaagtcagacataaaagaataaaactatgatggttccatatctgcaaagtcaaaaaatgcccaactaatctatgaaaataaaagtcaggttcggatgtagggttagaatgtaatgattgataggtgcacgtgggatttcttagtgtctgataaagttctgtttcttgatttgcatggttgttagaccaggtgggttcactgcaaaacttcatggaactgtacacatgatttgtgtactttttctggacatgttattcttttacttaaaagtttattttaaaaatcaaaaatagctttccgtgtgtttttcttctaaaagtcatacattttgtttgggtccataatcttttcagaatgtatttttatttatactctggagaaggtaagtttatttttctcctacaataatagtcaactcttcatcatgaatgttgcatcatttcctggtagtttttatcataatcttggccatgtatgcacgatccttttctcgtctttctcttctgttctatttatctatccttacacaataccacacattagacattctatagctttatgacaaatctttgcacctgatatggtcagtcccttctaattctcttctttaaaaattgccttggctattatttgccttttactcttacatgtaaatcaggaaacagcttttaaattttattaaaaatcctattgaaatgatattgaattgagatactaagttggagagaattgactactttatgatgttgaattatcccatcctggaatatgctagataatataagcacaaagacttcttttaagtcttctaataaaatgttataatattcatcatagatgtcttaaatataatttagaataattacttctgcataattttaaaatagggtaaattagtgcttctttttaatcacacactttgcattgagtgttaccagtgaaaggaaatgctaaagactcattagtaggaatcttgtatatagtgaagttaccattttcttgctaagttcaaatggttggattctcttggatagtctatatggacatttgtaaacaatgacggttttgtttctccccgtccttgcctatctcttttgtttgtttgttttgtgtcttcctacactggctactcttttccatccaatgttagcccagaaaccatgacagcatgcactttagtcttcctcttaatttaaaatgaatatttccatattttcatgcctaagtgtgttttctgtatgctttggtatctcttttttttttttgagaagattaatatagatctcttctatcccttgttttaattttcatattttgaattataaatatgcactgtgttttcaaagaatttatttttctttgcatatagaggtgatcgtattgttcctttttgtttaatctactactataatgatttacctaaatgaaatgtccaatattaaaccaaccttgattatattcctaaaatacaccttatttaaatatgttattcttttttaaatatacattgacagatgtactttgagggtcctcatctttatttgtacatttttagtcagttttacgagcaagagggtatctgttccatctgagcttgatcctctgatgattcattaattccttttaaactactgtttcacttcctttaatggttatacttctattcaggtatatttcttcctgagtcaattctaagatttgtttagaaaattaccaattacatttaaatgttcaaaattatttaataaagttttgtatattttcatattatatttttctactaattacattttcattttctgtccttatagtgtttgtcccttttctgttttgatcttgatcaatttttatataattttgcatgttagtactattctcaaagacctatagtttggttttcattttctctttttatctttgcttaatctctcattagtacctactcttattgattgattccttctttctgctatctttgcatttaatctatttttaaatttttaagataaaatatggcacatttattttcagttttctatcctttctatgaaataatgggtacaaatttttctctattattttagctggatctgtgagtcttgatacggagtgttcattacattcaatgctaaatatttcatattttgcattataattttttactcatgtgttattttgtttccgaatatatgctttatttacccttttcacaaaaagttgttgattataataaattaggaattttcttaatttattacaatacaatcaagagtttactcagtttgagatgaaatttctgtatatttgagactttgtatttgatcaattttcatgacaaggattaatttataaccattgaaagaggacccttcaattggccactggcttattagttatattgttgcaatattctctatccttactagatgttagtctctatgacctatcagtttttgagagcaatgtattaaacatcttataattctatacacttttgccttatgtattatgaggccatgttgctaaatgcctacaagttcaggattgtaatcacttcctgatcaattatttctttttatcattaactctccgtattcctagcaatgaaatttgtgtgtctttttgtttccatttctattttctcaaagttatatttgtctgctgggagtataattgcactagtttttgttttccttttggttatttgcctggaatgtgtttacctaacccttactttacacctttcttggcccttatgatttaattatgtccttcctgaattgcatatgtttttaaacatctaacttaaaggaatttaacctgcctataattagtatgattacagttgaataacaggtttgaactgtgcaagtccactgataagtgaattttttacaatattttagaataatttttggacacttatgacaatttgagaaaactcacagatgaactgagtagcctagaaatatcaaaacaattaagaaaagttagatggtcataaatgcataatatgtagatactagtcttttttgttattttcttctataaaatatacacaaattataaaaagttaaaattgatcaaaacttttatacacacacatacttatagactgtacatggcagcattcacagtccagaaaaatgtacataaatgtaaagatacagcattcaaccacaactgcgtaagattaactgtggtgcatactgtactgttgtaataattttgtagccacctgctgctgctattatggtgagctaagtgtggtagattgcaagtagctgcatgaaatgccacgcgatgccaatcatctccacatgagcagctcatttctccagtaaactgtggatcacaggaaaaagtgatctctcacgtatttttcctcatgggtagtgcaatacagtaaaccttaaataaaactatgggacacatatgaagtgccactagtaatgctgggagtgttcccatgaagcagagaaagttaggacattgcaagaaaaagttgagccgggcgcggtggctcacacctataatcccagcactttgggaggccgaggcaggcggatcacgaggttaggagattgagaccatcctggctaacacgctgaaaccccccgtctctactaaaaatacaaaaaattagctgggcatggcggcgggcgcctgtagtcgcagctactcaggaggctgaggcaggagaatggcgtgaacccaggaggccagagcttgcagtgagccgagatcgcgccactgcactccagcctgggcgacagagcaagactctgtctcaaaaaaaaaaaaaaaaaaaaaaaaaaaggaaagaaaaagttgaattgcttgatgggtactatagagtgaatggttacccaccatgttagacagacgattcatcttgtaaacagaaaacatgaacttattatagtcctgtaaatgtattttcttttccttatgatgtttataacattttcttttctctagcttgctttattgcaagaatacagcatataatacctataatgtgctaaatatgtgttaattgactatgttattagtaaagctattagtagttaagttttggaggagccaaaatcatacatgtatttttaactacacgggaagttggcatctctaatctttgtgttgttcaagggtcaactgtactggtaaacttgaactattcctaaaataatatttagttttttcttttttttttctttttttttttgagacagagtctcgctctgtcacccaggctggagtgcagtggcacgatctcagctcactgcaagctccgcctcccaggttcaagcaattctcctgcctcagcctcccaagtagctgggattacaggcatgtgccaccacacctggctaattttttgtatttttaatagagatggggtttccctgtgttagccaggatggtcttgatctcctgacctcgtgatccgccccctcggcctcccaaagtgccaggattacaggcgtgagccactgtgccccacctagttttttctaaataccatgcttgcattttttaggagtgatcatatatatatatatatatatattttgagatggaatctcgctctgttacccaggctggagtgcagtggcgcaatctcagctcactgcaacctctgcctcccaggttcaaaggattctcctgcctcagcctcttgagtagctgggactacaggagcgtgccactacacctggctaattttttttttttttgtatttttagtagaggtgaggtttcaccatgttggccaggctggtcttgaactcctgacctcaagtgatccgcctgccttggcctcccaaagtgccaggattacaggctgagccactgcgcccggccgatcatatgttctttgttgctgttttcctttccagtcatccctgtactcatttcatgttattgctcttgggtcttttgattccatcattttaaccttctgtcaattagtcataataatcattactgatttatacagcttaatttatacatattcaataattgattgctaatcgttgacaactacccctcccttctgaatttggtcacctttaggagtcatctccgtgaatatctgtgactgataaactgcttcagttcaggtagatggaattttctagttccagtcccgttttcaagaaagtttaatctatgtatgggtactggctttattaagggtcaacagttttagatcctaaccccaggagggcccaaggcactcaccctgtttctgtaaggtcatcacaacctcagaccctaggcctgtattcagacctgctgccccactagctgcccagactttcgccaaaactcaaatgttctcatcgtgaatttatcttcacttctggcatctagatatttcccttatttcgcactttacgtattctcgaacagtttcgttatgttgtatccatgtgtacgtaataggagggtattctctgttaacttaaaacagcatgttgcaggaacccagtactatctttctttgcattgcccatgcaagtgagccctgcaatataaccatcttgtctgctgagactttcttacacattttcagagtattttctaaagaagtcatcacatctaagatgcaagcttacaagcgagttcactaggggatttactctgtagacatgttgattttgatctaaatttaatgcccttgtttctacaactgtatttgtttactcttttgtgcctgtggtataatacactatcttatactctcaagcatttcaatacctcttccagtgtttctagatcactctgtctctctcattcacacacacatgcacatgcacacacatatacttttacacatgcatgcacacacatacatgagcacacacacatttacatacatgctcacacacagcacacagtgggacagtctgttcacaaacactacagaacaaacttccttgtctgtaggaagatatgtgtgcacctggcctctttgctgttcttacgacttgcccttcccaagttatttctactttacctctgtggttcgtttgatagaatttccagttaatgtattataagttataatatgccttttctggaataaatctttgctttcaatagatccattcactcctttccagaaatgatcgctgctttttatattctccttggaaaaacaaaagcacctgccttgacccttgtcttcaatatcacatataaccatacaaaactaaaaacaatccattcatttattcctttggttaatagatttttgttgggcagctatcatgttgtatgcggtgtgttagatgctgggtatgttctatgaaacaaaatagtctctgacccctggaagagaaagaaagaaagaatatccctcgccttacctttcttgacccatagtccaactgaagagagaagacgtctgttaattaactaacaatattaagtagcaaattctgagtaccaaatgagtggtattgagatcagctgcctatttgtgggctgatatggttccaaatggcttcacttgacagccttgaaattgagtcttgaaaagggtgcagaaatctaggtaaaaaatatcgatggggaggcatttcaggtgggagaaggaaatgaagaaagaccctgaggtgttacatggggtcaaaagaaaggatgattcaaagcaaggagagagcagagaagagttgggctgaaaattgaatttcctaccacttgtaggtaccaagttgtgacaatgagcttgtcatttcttgcagcacctgtcttatgtagctaaaagtctctttgagttctgcaatggcatattgcttctacggccaacattctgtctttgatagtgaggtcttacattagcattaaatcaaatgttatattgaaccttgagtaaaatctcttccaatttatgttttttttttattatttgtgtctgtgttgttctctgtgtgtgtgtgtgtgtgtgtgtgtgtgtgtgtgtgtgattgtgcacctgtatttgcgtttctcatctggaaaattctcttattcttttcccagggtttgcactgattttcacccttattcactcatctgaaatatcctttttcagtttaatcccagcattttatgtggtgctagactttggcttattggattgtaatttccaacttctaacctctcacctttgtaagacattgacactgaatcatctttcctcactctcagtataaatggtattttaactccaagctggctgcctgttaaattcatttactgtgctagagtgtatctggtaacttgcctgtgatgaatttgtgtccattattacattatagatggtttcatgcagccatctctgcaaagggcctaattatagctgtgatggccaaaactacttgttacctcgtgtcttctgactcatgtgacttgtacatgttttgacaatgaacagttctaccctccaccatggttagataaggtggaatctttttgataggagacctatattagttcagataaatgatgttgcttgttacgtacgaacacacatcactttatctcgttagcttgggaaatggatacgggcagagtgtattattcattttatatctagtgctgagagaggggcacttcacacaaaatagtggttcagcaaatgtttgtgggatgccaaaaaagcccccacaacaaaaagtggacctctttggttatccaagagagatgttttgtcttttggttctagaaattttttcttgcttcctcatctctcatagacatcctagaggagtgtgtgcatgtgtgtgtgtgtaatattaagcaaccagccattctttaccaatagaagatatccttgtttctaacaatgagacttcttctaatagtgctaacactttatctcatgtatgttatttattttttgaagatatagctttgcattttggaataattggagactcacatgcaattttaagaaataatacacaaagatcccatgtactctttgcccagcttcccctaaagttaacatcttgcacaactatagtacaatatcaaaaccaagatgttgacatcaactaatcttatttagatttctccattttgctttcatatatgtgtgtgtgtgtgtgtgtgtgtggtgtatgggtgtatttagttctgtgcaatcttattatatgtgtaggtttgtgtaatagcacctgctgtggtttgaatgtgttcttacaaaaacatgtgttggaaatttaatctccactgcaatagtgctgggaggtacagcccaatgaaaggtgtttaggccatggattgatactgattacaaaaacagcttgagtctgtgagcttgctgtcttgcccttctgccttcctccagagacccttgacagatgtgggccccttgatcttaagctttccagcctccagacctgcgagccaatagatctctgttcattacaaattactgagactgtgatatcctgttttagcagcacaaaaaggactaagacaccaccatagtcaagatacagagcagttctgtcatgaggacccctcgtgatactctgacagccacagccactccttccctccctaacccctgacaaccatcaatctattgaccgtctctaataatgtcatttcaagaatgttatataaacagatttataaaatatgtaaccttgtaagattggctttttctgtttagcataactcctgagatccacccaagctgttcatgtatccatagcgggttcctttttattgcggagtaatattccatggtattggtgtaacagtttaaccattcactcatttatggatatctgggtttattccagttttgggctattacaaaggaagcttctataaacattcaagtatggtatgtgagtgtaagttttcatttctctgggattcttgtctatgaattcaactgctgggttgcgtggtgattggaagtttagtttattaaagaaacagtcactgtttcccagaaagactatgccattttccattcccaccagcaatatgtgactcagtttccctctgtcctcatcaacatgtggtgttttcattatcttgtattttaggcattctaataggacttgtcttattgggcttattgtcttatttgggctactgtaacaaattaccatagactgagtagcttcacagaagtttatttttcacagttcaggggaaagtttaagatctgggtgctggcatggtccatttctggtgaggtccaccttctaggctgcaaacttctgacttcttgttgtagcctcatgtggtgaagagcagagaggagaaacaagctctctcgttactataatgagggcactaatctcattcatgagagctctgcccttatgacttaatctaatcctcattacctcctgaagtccacagctccttatccatcagggggtaaggtttcaacatatgaattctggggtacacagacattctgttcataacaggtatgtaatgacatttactttctaaatggtatttgaatgttgttttgtttattgaataaccataaaccaaggagttaagggttgcagatgctgtaaaccttatttaacagatgaagcaggctgggtgctgtggctcacgtataatcccagcattttgggtggctgaggcaggcagatcacctgaggtcgggagtttgaaaccagcctgaccaacatggtgaaaccccgtctctactgaaaatacaaaattagccaggcatggtggtgcatgcctgtaatcccagctactcgggaggctgaggcaggagaatcgcttgaacccaggaggcagaggttgtggtcagcagagatcgtgcaattgcactccagcctgggcaacaagagcgagactctgtctcaaaaaaaaaaaaaaaaaaaaaaaaaaaaaaaaaagtagatgaagcaagttgctcaaatcagacacttgtttgagtcacaaaataatcaatggtagagctttgtctgcaaccctacattactccctcattgttttatgttgtcctgattaaattgagcttctaactgataataaaatctattattcccaaaattgggccacccattccccaaacgtcctaccttcattctagaatgtcaaacacaagccacagctgagcagcaggacctccatcagcatgcaaccacatggccagccacgccctgcgccaagcctccagatggagaggatttggtgggaaatcatttctgctgctttccgcattccgcatacagtgtcttcttttaacatggcctcttgagagccactctccagcggcagcacggccagcctctgtgcctccactctccaccccaccttgcccatccacagctgtcttccctttctcttctctctttgcagctattctcccttcccaatccagcacagcagtgtggctctccttcctgtacactggtctcctattttcccttctctcatcacataaatcaggctcacatagggttagcttgcgttagcttcttttaactggttgttctgttggttttaattttcctatttttgggattggtttaattatgggaggagttagaggctattttaatgaaataattatggaattagcctaggttttttgaaagaaagaggaaggaaaggtgtgttccattctgtttgcattttttcttctgtatcaagctttgatgtagctttttttccaggcagaatttaggtgcaaatggaaaggtctcaatctgactcaagtcagagtactgtgtgtggttgttctcaatggtttattaggttttatagctctgttttcttttcttgacaaagttatctcacctttgcttgaaaaccatgtttctctgaactatttggtggtttcatgattgcttgtgcttaaattaatgtcagcagcaaggcaatcagtagaaacttcaagtttaaattctcctgaaagctaactttaaatgttaatgtttcatttaattgaagcattctgagatattagcattaaccatttagagcacttttattagataaacggaagaagggagaaggcctaattattgtaagtcatttctgttagacatttatagagaacttgcctttgatgagaaaattgcaaaagaggccaagtatgtcaaatgttgttgtcttccaattcccatttcaatgtgcaaactaatcattcacttccctcatgggaccgctgtgagtttaactgggcaaatacatgtggagtccatgggtgaatctttcattcagtgcaggctacgttgggcgctgtggtcagctggaggcccctatttgacaagagacggtcagaacttagtgtgtgttttctggggctgttttgattttcctgtacaggagagttttgcagggaggcatattgggctggaaatcaaaaggccgtggttcttgcccatctttatcatgggtagatttctggagccagaaccagagccaaataacttcctgacctgcaaaatgaggaggcctggaagattatcctaacgagcctctttgctctgtagttccagcaattatatgtattctgtgaaaagccaataacgtgcaattcctgatagtgaaataactctggagcccatgaactcatgcttcataggccagccctacagattaggaaatgggtttcttcctagggtttttattcaccgtacaatactttcacattttctttccaaatgactattaatcacatattgaattttaaaatattataatccattttccctccagtttttgtggaaaaaaatgtatacacataacgtttattattttaaccatccgtaagtaagtatacgattcagtggcattaaacacattcacaacgttgtataaccatcaccactatctatacacaaaactttttcatcacccgcaacagatcccaatgccttttcaacattaaatactgacttccccttcccactgttaccattcacaatgttgtgtaaccatcaccactatctatacacaaaactttttcatcatccacaacagaaactctgtccccgttaaatactaactcccctttcctactcttaccattcacaatgttgtgtaaccatcaccactatctatacacaaaactttttcatcatccacaacagaaaccctgtcctcattaaacactgactcccgcttcccactcttcccagccctggtaagtctccctctgcctgaattccccaggagtttgcctattccaggtacctcgtacagtgtctatctttctgcatctggtgtattgctcttagcataattactccccctccagttttaggagaagcttcttcccaaggagatttttgataagaacaggaggcggccagctcagcttcctgggatgatttgggtacagccccacccagatgtctctaatttggcgttatcagagtcagtcaccccactgaaaagcccgcctacccatgagcttgggaagccctacatttacaggatggtcagctgtccccatgcccaggagtggttctgtctggagctgattcacagctccatcccctagaaactgtaattcaacaggtcttgggtaagatttagggatctgcattctaaagacagattccattgatcccagtgccttttcaacagtgaacactgtcttctgcaaacagctcacaattgtccatgaaattttgagcttaaggaagttctaacgcccccctcccctcctttatttttgagttgaaagagggtagaatcaaaaacaatactgagaggggtctaaaaatgcaaacacagagagttgctggtttaggagggctgggaggctatgggagaccataggcatagagaaaacattccttctctgtgactctcgggcgcgagcgaatccccaagggggtcaccagagaatcatttcctctttgggaatacaacatgagatggttctttcatctggacctaggttcaattaagtaaatagagcaaatacaaataagagaagaaaagcagcacaaacagtgaaactaggtctttacatacctaaggaggagccgtgagcattcgcctccagggaaccacagtgacgggaaacatgctggaatgttaaacgttccatctcatttgtaggaagcagatgcctacatcttcaaattttgtcttcttaaaaatattattttatccagataaaaatctataacctctagcaaagaaaaaacaacagctgcaagttggagatcatgaactgtctttccaaagaatctccacgtgtagctgatgtcagatgccatcagcagtcagccttcatcaccccaacgccaagtatttgttcagtttctgctccatatgaatgcatcttggatagaatgtgtttggtttggcttttaagaaggctcactgacttagcccatgacctaaagcatatacttaccaagccttggaattcctacagagggccctgcactttgtgtttggtacagagaccaaaaatacaaacccagctttgaggacagaagggcagggaagcaggctctttatgctgtgagtctctcactccaccccatggtccactctggaagcagaagaagtttctttggggatataaaatgtattgttggcaattgtttttgtgtgcagttaaggatcctggaattacagcatctaatgttctaactctactgccatatccatcttaggaatagaaatgcaattgcaaatggcaatttgaggtaagcaatccgattgtgcgaataggtcatatcagatggccaggaatcaagggtcatctaatgagactcactgaccacaactgaaatcagccaccagactctattttctctctgacaattgtgatatggagcaaagaacttcacctcccaccaccatccctgcccgttggtgactgctcgtgaacatttggttgatggatggacaaatgtatgtgtgaacaaataaattaataaatatgtaagagtattggttactggagtatgtattactagagaaataagcaaagacctgctccatacccttcccccaagaaaatagcaaatcattctcagttggaagactaaagagaaatgctagagtccaggccaatggaaaacaagttaaagacagaaggtttagtagcactggaaaacccaggaggacaaagattctccaggtcatcgggaggcgtcgtgctttttttcatgggaaagaaaacttgacccagagtggcttcattaaagaagggagagggacttcataagtgaccagtcgagagctaggccataggggctgcagacccgggactcaaacgatgtgcaaaggcctcagtttctctcttggtctctcccacaatgctgtctgctcacacaggctttccccctttgcactgttgctggttgcattctcgctctttcccccataaggctattaaagttgctgctggaaggttccagagctgtatgatcccggaattgtaccctgtgaaaaagcatagctgcttttctcacagagtaaagaggtccagccctgagttattttgcccctaatgggtttccagggtcgtgtcctttcccaacccctgaggaagctcagcagagatgcttcaggatgagattaggctcactgagcgggtgaacggagctgtttgaactgaggtctcagggagaccagccctctaactgcagcgagctggatttcagacccttcctgtgcacacacactgttgcttgcccagacatgcttcccctttgtcttgttagaccattgatttcctttagaagatcaaaatcagggtgcaggtaggagccttagacaatttctagtttgactctcatcatatttttaatatagccctgcattttcctcatatgaaagcagaaacccacagagtttatgatgtgctcagagccacgcacaggatcgctagaagccggggccacagcccagcttccaccctcctgatggggaccatatccatgtgctgctcttacatgtactgaaaactcagcacatgcctactaaatgctctgtaggctttatctcattttaacttcacttactcatgtaatctcagcactattatcatctgcatgtcacagaggagggagctgagatgcagagtatgtttgtgacttgcccagagttacacactgatatggtttagctgtgtccccacccaaatctcatcttgaattgtagctcccattatccctacatgttgtaggagggacctggtaggaggtaactgaatcatgggggcaggtttttcccatgctgttctcgtgagagtaaatgagtcttacaagatctgatggttttataaagggcagttcccctccacacattctcctgcctgctgccatgtaagatgtgactttgctcctcatttgccttcagccatgatgatgaggcctccccagccatgtggaactgtgactccattaaacctcctttccttgtaaattacccggtctcaggtatatctttattagcagggtgagaacagactaatacgcacataccatcgattggcacagcataggcactccatgttcatgactccaaagggtaccatctaccacctgttaactgcctactagtatcttcaaatcaacgtaagcctcgtagcgttacctattgctgccttgtcctaagcaatcatgttaatggtatctaggttggatgagctacttatatcttttcaattatacaggaaaaacaatggaaaattgtgataatgaaaagaatgtttgctcacaaaccactgaagatggcttcacctgccaccagtgatatgtgaacacacttatgaaactctcacctatattacacagccagggaggctagtgtatttgtggctgatgagggatcaataagcttatagcataacaatacaggtaaaaatttgtgaaagagccctggtcaccttcagggatggaattgacagcagaaagcccacagcaccaaggttaagtactttgttttgtgtgtatttatgtgcagaaacatagatgtgtatatgtgtagatatacaaccacattatacgttatacttagaagtgcgggttgcatacgccactgcacattagaatcactatacagaatccagcaaatcagattctctgatggtggggcctcaacatcagtacttttttaaaaagtcccaggtgatgtctaagtggagccaggtttgcaaaccaggtacctaggatagaggttttcaactcttggtgtgctcacagagaagcacttgaagtatctgcacagctttgtcaaaatgcagattcaaagcctcaaagattctgatgcaggtaatctggggtggcccaggaatccgcacatttcacaagcacgttgaatgattctgatgcaagtgaagggtctgaggaccacgccttgaaagctctgcacagaccccagctcctctagaggacttgcattgccatctggtgaggactgaagacccacattagctaattacatcagtatttttaactctgggaaaatgtaaaaagaatttagcacccagtgtaaatatggaaagattctttcttaaatgttcagtagaggaccctgagcatatggtgactatatagtcagtagcgactgatcactttttaatgtcagtttcatcgtaatcatacggcttccgaatgccacacattaaaatgttaggtccttttcttcccaacccaggattaaaattcatctcaaaggcaaaacatactgtgatttctcaaatgtttttggaactgtcaaaaccagaggatatatttagaggcctttaatgtagaacacaaaatttcactacacgcagaattgccaattaggatgggaggctcagaaatgatcttaatgacacaagtgtgcagtgtttttttccttctgcattacatgaataatttcaagggtgttttcactctgaatgagttttttttcctccatttggcactgcctgtggagtcctctctatagcagaggtgatgttacgagctgtaacgacgtccccgtcagcaagtagcacatgcttttccattagttatacttccataccttcgtttgcagttttgtttttacatacaggattgaaacaaataccagatagtacttttccaaattgttttggtggactcctccccatccacagcggcagacaactcacattaaatatgaagctttcaccacatacaatcagaggcctatcaaaatagcttcaaacttcaaattaatgccattttaggatcactgatgcttttctttagaatgccatacacttgaaatcttctaagactacaagaactgtatggacatttatagctgaaaagaaaacctatttttagaactcagagctgaaaccctacctcaatactacccctatgttttcaagagttcctgtttcccaatgctagtcaactctgaacctgaattttaaaaattatttcctctctgtttcctccctatctgagaagtcatttatttgatggttttagcttctactggcaactacgacatgatttggaagcctgctaagaatgagtctataatatgtttatgtcatgtattaaaaatctccacggtcttataacttaatataaccctatgtgtaattagttgaccgagagtccttttcaacattgattttgatatatgatttctaatttatttgtttatttacttatttatttttgagacagaatctcactctgtcgcccaggctagagggcagtggtgcaatctcagctcactgcaacctccgcctcctgggttcaagcgattctcctgcctcagcctcccaagtagctgggattacaggctcatgccaccacacccagctaatttttgtatttttagtagagacggtttcgccatgttggccaggctggtcttgaacccctgacctcaggtgatccgcccaccttggcctcccaaagtgctaagattagaggcatgagctaccgcaccaggcctctaatttttaaggttttaattctaggccgtaattttttctcttccaacatgataaaaagggtcttcccatgcccttctcttggtttctcttccctcctcatgcctaccgtttatctgtttccatgacctccctgcccacctcaagtcaggtggcacttcaacctgctggcaaacagtgccacccaacactggcacatgagtccatagaatgtctgggaaaagaggcttgtcgtaccatgtgatgtaaagtactaactgtgcaaacgtgcggcactcaacaattttaggagctttgtgattccttcttaatgatgtgcttaatatatttcccccaatgattgcttattttctctggttttaccctcctttatcaggtccttattgaatttcttcttttcctagttaaactggaaaagtaacttattactctgccaggcagtaggatcactcaccaagagacggtaatgagggagaccacatagcccagttggtctggtgatgcctgttttcccaacatagttattaatagcaccactttcactttgccactttggatggcaaatgatatagcgacaatggcactacatttgctactggcagctcaagaagatgttacagaggctggttttgacggaatcacatatgccagatatgtggcatatgtggaaatagatgggaattatgctggaaataggtggaggcccaattgaccctgcttgctcctgtttacctgtagcctctgcttttctgcttcagcctggaattgtcacagaatatcccagacctcctagtctgtacagggtctggttggacaagacccactggctttttagaattactccggaagtcctggcttgctgatcagaagacttgattcttccagaaagaggtagccaaggagacagaaaacaagctggaatcagagcaagaaagactatgtctaccaaacatccccgtctcttcctactctaactgtagatacacgtggataccatagcagcatgaatgagaccaacaccatcgaatgaccattaaatgaatggtcattcgtttatggggaagcagtactgcagggattatgaggtcttatggtttaaagtacagcacacatggaccacggtcccagccagggcagcctgctgtgggaatctctctcagcagatttttgcctgttagattccagaaccttctctggtcactttcatccaatctaattgtctgtcttacccaagaagggatttgttacaagggacttggtggattaagctaaagcaatcttaaatgcagaatgccaggtttctgatacagataatcaatttcagttgctgcagaaaactctgttgggggtgatggagagaatgcactttgtggacccgtctggattgtctcctagtcttgtatccaggtggcactgagcctcatcagtggggtccactctgttatttcctggcctttacttggtgagataaacccttcatgttcagcagccttgtaacagtttgcagaaaagtctccagcctttgcttatgtgttgggtgcaagtctactgatacatcctgagggtgtatgctgttgccggtgcgttgcactaaatgcctgctactgaaaatatgcccagggaatatttctctttatatctgtggaactttgtccatcgctgtgctggaaacaaactattccctgggcagtcagtggtgcgcttttaattctggcctgtgtggtggcagtgggaggggcggtgccttttgctgcgtcgggaacctcttgatcccaccagggtgagctgaaagaccttgaatatgatacttcaaataataaaaatgtatgtgtcaccttggatctgcccagaaaaggggagaggattttacaaacacacacacacgcacacacgcaacacgcacacacacacgcacgcacacgcgcacacacacgctgacacacacgcacgtacacgcgcacacatgcgtgcacacacgcgcacacacgcgcacacacacgcacacacacacgcacatgcacacacagagtcattcaggaaaaacaacaacagaaaacaatttagcacatttttggtgctctgaaaatataaattgggattttatctaccaatattaccatttatcaagttataactatgtatagcatttaattgatataaatacacacagcataaacttaccccaaagtatttatgctttaaaaatttatttacaaataatctgggagaaaaaggtttatttcaaaactatatagagggctgggcatggtataatcccagcactttcggaggccaaggcaggtggatcacttgaggtgaggaattcgagaccagcctggccgacatggtgaaaccccatctctactaaaaatacaaaaattaggccgggtgtagtggctcacgccagtaatcccagcatttggagaggccaaggcgggtggatcatgagatcaggagttcaagaccagcctggccaaaatggtgaaaccctgtctctactaaaaatacaaaaatcagccagacgtggtggcgggtgcctataaatccagctacttgggaggctgaggcagagaattgcttgaacccgggaggcagaggttgcagtgagccaagatcacgtcactgcactccagccagggcgacagagtgagactccatcttaaaaaaaaaaaaaaaatcagcttggtgtggtggtaggtgcctataatcccagctactcagaaggctgaggcaggaaaatcacttgtacccaggagacagagattgcgccgctgccttccaacctgggcaacaagagtgaaactctgtctcaacaaacaaacaaacaaacaaaaaatatatgcagagaagagagtacttaggagcacagtgggagggtgagatgtcagggctcagcatctgcttccgaagttgtcaccaggcatttgttcagggcatgtgggcactaagaggatgaccccgtggtggtcaggtaccttgctgctctgcacacaaacaatagaaagcaatggagcccttgttagaaacacatatttctaagctccaagcctggagcctaggaaacagtgtctcccaggaagaaacctgttaatctgcaccatgtcagggaccccaccccaggattcttaccagtagtgatgggtgagaaacactggctatgctaacagaagcaggcacacagcggccccgtcttcctcccatctgtgagcatgcttcagggctgagcatatgaccaacattttacatttcagagttggctcccaccttaacacacacaacaatgtggacaccaccataaactgtgacatcaccatcacccggacaccagtgggatttatgttgtgtggattaatggccagtggataaatatacagcaataccaaggggcaggtcaacagcttaaagattaggagaaaacaatgagtcagaaactgagcaggtaatcatcagagcatccgtgaataatctgacagactcctcagtcttccacatgtgcacgtggggcagaatgttgacatccaagtgggcatggtaagcagctgatgaaaagttaaggatggaaactttaggcttgaaagtcagcaaagtgaagctgacttgccaagaataaactaagcagctatgtggcatcatgcagatacacacacagacacttttttttttttaagatagaaggagaaacagcaggagagggaagaagtggaaagaaagatgctgacttgactggactcttcactgctaacctttggtgaaggataagtttagacacaggctgcctacatgcaagcatagagatatttctagtgtgccttcttataaaggaagcacaggtagatgtttgtctttgtatggttgtaattaagcgccaaatgatgtcctccattcccttagtgacctaggaagagaaccagctgtgcagcaccatctctttgtctgtttttggaagtgagcccaatgcacttgaccctcagtgctatgagggaccagggggctgacaggtgaaatacagcagggaaggctgcaaagaagccccaagctgctgcgggcagggtgtgtgcaaggcgcacggtacagacagacccaccctgtgtttgtggggcaagccccctgtgcctttccccctctgttgcctctttcagctgccctcagtccttcccacaattcatcccatctcccagcacctgttttggatttggagccagtatatgcaggagagaaaaagaagacagtaaatcgagcaagaaaaaggaaaatgttgtattctggagcagaattacgaatgagtcagcagcaaggtctgacaaaacaaaatacaaaggcagtaaagtaggaggttggctgccaggctggtgtgaagctcggatacctgtttctcagtggccgccagtagaagacagggatatgacaagcttgggaagaaagcaggcatgctggtgtgcatcctggaaaattagttaggaggaaattctcatgggtttcttcctttgaatttcctcctagcaatgctatggctgatttcatttgtttcccagaagatgagctgaagacacataggagcagctattggaattgaaatgtccaagtggagactgaaggaaatatatattttgtaattactcagctatttctggatgtcacagatgtttttgaaacgcatatttggaaacacagttgaaatcacaagtgaaatttttattgttcatctcctaaatgtaagctttttattttatttagaggcatcctcggttttaatcatcttgttatacttagatgttctcctcttaacgactcattgcaaaaagaaggcattctatgtgaagggtacagagaatgcgagaaacattctctatcaatgacctgaacaactagggattgatcagaaaagaaggaactaaggtataatagcgttgggtgtggtatggaagtagaagtcgtttgagatacatatttgaagaagctacaggttcaagaagaactcaccatttctactctcttaaatgtaagttttgtgaaagaccagtgactactataagttagtttattccaggaggagagaaagagctgagatataaatactgaatcctaaggatttgtccattatttttgtgtttggaatctgacaactgtatgtcttctatattttaacccttgtataaatggttgcagtaaattgcctagagcagtgaaggaaagatgtgcagccaagggaaagatcaagaaccttcggtttacatggagctatttcctaatatttgttttatgtcatatgagctaaacatctttaccttttactaaatatttcaaattttatctggggtccattagaaattttttctttttttttttttttttttttttttttttttgagacagagtctcactctgtcaccaggctggagttcagtggctcaatcttggctcactgcaagctccgcctcccaggttcaagctattttcctgcctcagcctcccaaatagctggaactacaggcacccaccaccacgcctggctaattttttttccttttttttttttttttttttgagatggagtctcgctcgctctgtcgcccaagctggagtgcagtggcgcgatctcggcttactgcaagctctgcctcccgggttttcgccattatcctgccttagcctcccaagtagctgggactacaggcccctgccaccatgtccagctaatttttttttgtatttttagtagagacggggtttcaccatgttggccaggctggtctcgatctcttgacctcgtgatccacctgcctcggcctcccaaagtgctgggattacagacgtgagccaccacgcccggccttttttccttttaagtcattataacaagacgtttaacttcatgcaaatggtataaaatatattggcaaggagtgcagaaatgtttgccaaatatggtcattaatatgggggtgactacgacctgcttgagagaagagaagggaagacttctctagggaggactgattcattcaggaagttttccatcatccttcaacttccgcatcaggacttacagttcactggaccatcagccacaggagtgggcccagacaccagacaagaagtcagaagttttggcaagatgccgggtctttgggtgagtgcccagtgagaggtacaaatgcaacaggagtctgacgccatggagggatgtgacttctgcagaatcttgggaagggggcagtgtgggttttgcatgtgggagggacttaaataacttttatcacagccaaatgtgacatgctaaggcctgaatgcatttattcatggttcaggcagctgtagccaacaacaagaagcagttaaagttatgtacccactgagagcagatagcggggaggcagaggtcagcacctgcttgcctgggagctgcagggtttctgagcgggaaggaatgttagtggttgctggttccatctcaccaattcctgcattcctgcattctgaatgcaccaacaaatggcttccatccttctattaacaggggctgttgagccttttcagtgttgaagtatttcagactaccaaaagacagtttcatggttctgaaatctatttccttctaatgtgtacttgtcagccttattcttcccatggaagcaaaagagaccaggcctactgacatgcatgtactcatgaagttctctaaaaccttaaagacatctatccctctcccccgggtcgtctcttgtctgtgcagaatacttccacttgctccaagcatctctcaggtagctttgtttccagactcagccaacctggtcatcttctctggagtattttggcttattggtctcaccactagaaaaaagtgacaccctcaactggacctgttacttcaaatgttaagggagaaggttttagacaagataggacaacatgtcttcccagaaagaccttatgagctgggtagctcttgtctccgcccacattattagagatgagctcgtttattttaactatccaaagaaggatctgggtggaaaatggggaaagtctgcttctgcctcccctgccctgaatgcccacctgataattagcccttccacaaagcgagtccccaggggcttcctggaagcacagcagctgctacatcgtgcaggaccatgacagtggatggaattaattactaaaaccagccaagaccaagattaaggaagataccatgtaaatgtggcaattcgcgaagtatttctgaaaaatgaggcatctgtttcctggtctcacctctcctcatgtcaggtgaaaggtgtggcggggaatgggggctgtaattcagacttaactgtttgattgatcttctcggactcctcaaggttatcagagtaaaaaaaggaatatgtacaggacattgctttcatgaagtgtctgtcacagtccacaaaacctcggcttggattgtgaaagcagattgttttctgtctcctaggggactgtctattgtgttaatttccagatatggatatgactgtgccatctagcacctaacggaacttcttttttatctgttaatgatggaacacttcaaaattgcaagaaaataaaccctttgagtaaacacttcattttctcattttcctcagttttagagccaagaaatagaatattttccagcttctttttggtgcttttatttttttccttcaggttttactttttttcccttctcacccctgacatctcatgcagataactttccttttttttctcttttttaccacccagtctctaaatctcactttcttttctctgtctcatctgccttttctctgtgttaacttttccagtattttcagccttgcttctcattatgttactatattgtgtttctttaactgtgtatgccagccatggggttcttgattctagcttaagaaaatctgactctgggctcatctacacctcctgttatttttcacttcctctttgaatggaattgtaggattaaataaggaaaggactgtggaggtcccctgaagcaattttcctgcaatgcatgcacccattccagaggactccagtggtgcttcgagcccctgctcatatgctatccatgctggggagctcaccacctcagggagaccatccatcctcatacatgctctaagtggactgcactaatgctgaccagacacccagtccaaaatcctgggtaacaatctcagtcattgaaggcagctgcaactctgccattcttaatgggattccggtttgccaagagccccagagagtagaaaagtaagagtttcgtggactctacacaatgctggtaactagatcatgcaattctcagaatttagaaaagagtgttttttattcctttcttgtgatttgaatttcctcacaacccttagccctgtattacacaaaaggaaactgaggctcagataagcaacttgtgcaagttcacccagcaagtgaataacaggctcagatgacctctgcgccttactctaaaactgcctaatagtagtagctgtgtcctactccagagctacacctagccaccctcttctgctggcctcagcctggtgcattgttaggaagggaatatctgaggtgatgtggaggagggaggggagcacaggcaggccagacaggggcaactttggctactccagcatcccaaactagggccgtgctagagggtagaaaacgtggtgtaaatttaaggggcattctcaagttacaaagtcaagtgaaacttggtaatcatgtttacatggacagtaaggaaaataagcaaggggaatggctgatgcgaattccaatatttttctgtggaaagaccaggtacatggaaggaaacagagaattctttagcagaaaaagaatgtatctctctaatgcccagtgatgatgagctttttttcatgtttgttggctgcataaatgtctatgcagccataaaacaaatgagttcatgtcctttgcagggacatggatgaagctggaagccatcattctcagcaaactaacacaagaacagaaaaccaaacaccacatgttctcattcataagtgggagttgaacaataagaacacatggacaccgggaggggaacatcacacactggggcctgtcgggggatgggaggcaaggggagggagagcattaggacaaatccctaatgcatgcagggcttaaaacctagatgacagattgatgggtacagcaaaccagcatggcacatgtatacctatgtaacaaacctgcacattctgtacatgtcccagaacttaaagtaaaatttaaaaataaaataataaaaaatttcacctaaaaaaaagaatgtatttcattttcaaaatattgaatttggggttaaagtttggcataaaaacatccatgtggaaaggtccagcccaagctaaaaatataagtttagaactcagaagatacatgaagcataaagacgtaaattcagtaggaagctgtgtcagaaagcagaaatgatggggacctgccagaccaaggcttagaccagtgaggaaggagcccctgggatggcaggttggtgcctgccttccattcgggtctgcagcagcaggagagaaaggtgaagagcctggatggaggggcaggaggcgaaggagagcaggtcctggaatcaggaaaggggaacagctcctgttgccttcatcacgtgctgcaggctggaaatcagaaagatgccacgtgtttggtagataagggttagctgggagaactcattttgagaatgctaggagtatattgcagtgggttaaaagtgaatagaaagtgagccagtgaagcagtgtagactttgcttgtgaagggccatgatagttacaagaaggaggctgggtgcagtgtctcatgcctgtaatccaagcatttgggaggccgaggcaggagaatcacttgagcatgggaggcagtggttgcggtgagccaagattgcaccactgcactccagcctgggcaacagaacgagactctgtctcaagaaaaaaaaaaaaaggaaggagcagttccaagggaatatggccagaggttttttgtttgttttgtttgtttgtttgttttcaatgagggagatttgagttatattctacagaattagaagaagtaataggggagaatgagtggttagaaatgtaaggcacagtggagaagttgttaaagttcaacaagaagcaggagggtatgagcttagtcttgcaaaggaagatggcagtttcaaaacgtcagccggattcaatttaaagcttaattaagcagtgaacaatttgcaaattgggcagcctcctgagccacaataggctctgagactccagtgcagccccatggtggtagaagatttatggacagaaaaaggaaagtgatgtacagaaaacagaagtgagggacagaaacagctggattcgttacagctcagcattcaccttatttgaacatgcttcaaacaattggctacgtttgattagccaaaacttggtgattggcgcaagagtaggttatggtctgtttacacctccactggttataattcacaatgtgcagagaaacctttaggctgaacttaaaacatgtaaggaggcagctttaggctaaacgtgacttaacggtagcttctttgtaggagaggaaggatggaggagaggcctgacttagggcacttgacctaggaaggaagagtagaagatggatttgagaaagacttagaaagttactgattagaaattgggcgctatttgattgaattggagtaggggaagcaaggggtcaaagaatggagggaaggaaaactacattttcaactcagcttactgagtgcatgatggagctaccaactgagatagggattatcaaaagggagcaaggtttgggggctgctgaagagtttattctggagcaaattgagtttttggtgcctgtgagacataggatgcagtcatctgatatattggtctgtagctggacctgtgggagttactgatatttaggtaatttaggttacggtttaaaatctcaagaatggaagatttcataggggaggaggatgtaaagggagtagatgagtggccaaagaaaaaactcagtgtccacgatggtacagagaaagaaaagaccttagaaatctaaagtatgggtccatcggagagaaggaggggagagggtagaaatttcctgactagagggaaattttagagagataagaagcagaccaaatatgaactcaccctgtgacaaatcctcaactgctttctaaaaaattattgaatgccaatgtcaactattttgtgtgtaatatattaaaaaaataatttgctgaaactgtttttccatcttgtggatagtgttttgggaaataagttctcctttattcattttccaggagagatattaatgtaatgctataggatgagactaaaataactcatattcatgaacttctaaaaaatggcactcttagaaaaataactgaaagcagccttactaatttccaatctttgtattttttatgatcagaaatatttagtctattttattttttatttttatttttatttatttattcatttagtttttgagatgaagtctcgctctgtggcccaggctgaagtgcaagggcatgacctcagttcactgcaacctccgcctcctgggttcaagtgattcttccacctcagcctccggagtagctgcgattacaggcacccgccatcctgcctggctaatttttgtatttttgtagagatggagtttcaccatgttgactaggctggtcttgaactcctgacctcaggtgatccacccgcctcagcctcccaaagtgctgggattacaggcgtgagccaccactcctggcctagagtctattattttaaagaaagaaacataaatacaacattgaccacagaaaaagaaaaagactttatctctctaaggaacaaattctttcagtgagatgcagctttcttagtgcctttctagataaaacattgtacaaatgaaaacgcttcaatttgcactctttaaacagtcattccctttgtgcctgcagttcttttggcttgatgttgaggaagattttgtggaagacaatgatattttattgcttcatcttggagcaaggagaaaattgtttctcttcttcccacttccccattttttaagagtagtgctcgagtcacacttgcacttccacgctgaagccttctatttgtatcaacagtgtgttctggaatgccactttcacattcccacacttggcagacccagcttctcaggttttctctatttcttgactttattcatttttgtttcagcctttcttttttttttcttttttttttttaattatactttaagttttagggtacatgtgcacaacatgcaggtttatatcatatgtatacatgtgccatgttggtgtgctgcacccattaacttgtcatttacattaggtatatctcctaatgctatccctcccccctccccccaccccacaacagtccctggtgtgtgattttccccttcctgagtccatgtgttctcattgttcaattcccacctatgagtcagaacatgcggtgtttggttttttgtccttgcgctagtttgctgagaatgatggtttccaccttcatccatgtccctacaaaggacatgaactcatcattttttatggctgcatagtattccatggtgtatatgtgccacattttcttaatccagtctatcattgttggatatttgggttggttcctacccaaaggattataaatcatgctgctacaaagacacatgcacatgtatgtttcagcctttcttataggcgattccattttccagatattctattctagtccccatgcatacattttggttttgatttggtttggtttgggggtttcttgcctaacggtacagacgaacaattaaaagcagttctctcctcctcctcctcctcttcttcctcctcctcctcctcttcctcctcttccccttctccttctccttcgtctccttcttctccttcttcttccttcttctctttcttcttgccatggccttgatagggttattttaattgctctccccgtttcttatgagcaccacttaaaagatatccacagagctgaattgcaggggtgtgtagtggtatattcaaagatgaatgtaaagatgtaactctaggtgtttgttttggggatggcataaccagggaatgaatttaaatcactgtttctagatggattaaagcaatggaccttcaaccaggaaagatggcagctattcttactttgcatatttattatatttgttgctatactgaaattttcagctgacaacagcgaacacggacttctgacttgagagttacgagatacaagcttggttcaggcaatttccaagggattgtttagagagagacagaactcaggtcaaatcccacttgactttaacttaaattccttaagattttattttcctacctgtacaaataggacaataatatctgcctcataaagactaaatgagttcttgcatggtaaggagctgtcagagtacctaatatgtggtacgtgctccataaatgccacccacccccaccacccacttcagctcaccactgtcaccatctctgggacttggcttggctgaagtaatatcaaaggcttcctctgagtgcttcagtctgtgagtggtcctctcccagcccctcaccacctctgtcctgatactattttaacaaggaatttatctgtttgctttagaagttgctggaagtttacaaagaagaaacccagtagttcagaagaaacgtatctaaatctgattttaaaattatctgttttctctggatttaaactagctatattacttacctattgctgtataagaaattaccccaaactcagtggcttaagacagccaacatttaatcttgcagtcactgtgggtcaggaactcgagaacatcttagctgtgtggctctggctcagggtccctcatgaggccagcatcaagacattagccagggttgcagtcatccgaaggcttgaccggagatggggaacccatttccacatccactcacatggcttctggcaagaggcagtctaacgggtatgagcctcagactctccatggggctgcttgagtgtcctcacaacatggcagccagcttcctcagagcaagtgatatgaaagacagcaagaaggaagccacgatacctcttataagctggctgcagaagcctaacaccctcactgctactgtattctgttcatgagggtcactaagtcagccaacactaaagggtacagaattaggttccatctcttctcttctctctcctcctctcctcttccccctttctctttcctttatcctcttcttctctttctgtgcctcagtttcttacctgaccaaaggtaacttctgccccctagggatgctatgaaaacaaagtgagatcaatcatatgaaaaggcggttttggagggagagttcagaaactctatataatataccatataccataaccatggaaacctgagatcagctctgtctagcttcctgctcttgcatctgaagaagccgttccagctcacacaggcatggcttagtcacagtgcagcatggggtcctttaatgggtcctctctgagcggtgacctgctcaggacacaggagccagcaccaggcccttccttccttctcctgggcaagcagcaccactcatcccggcagaaatagaaaaaggagttaagttcctgtgttccttattagattgctgtagcagctccataaagctctcctagacagtcctgtctgttagtggctgtttctttatgactaaagcagcactttcccatctgctgccctcaaagcaaggggccccgggccgcatatttctggttcaggagtctcaagatctctgaaagcaccagattgttgggatttaagtgctgttgtttatttttatatctgggtcctgttcctccaaataactccaagaccattgtgattttcgagaagttaattcagtggtgcaggctaggtagggaatggtggtattagcaaatcctacctgttttctttgcaagctcatttccatcattggtcctccaaatgcatttccctgttcaaagtactctaccttggatatgtctgcctttgcctccacgtccctcacctattatctttagaaaggtggttttaaatgttggtcactgaacatttagccacatagggcaccagctctcagaggtttcacaagtaaaggaaagggttgggggaaatgaaatatggttcaacgcaacagagtaacccacatattccgtatgttcgacaaggtctctacccaggaggctggcgatgaaggatgctaacatttcttgaaccgccatcttctcccttcttttgggtaaccctcgaattctgcttatggttatctatggattgtggagtcatttcctggctcaggaggttaagaaaggcgtccgagatttgagggttacaggagtttggaagcactgtttttctggttttctgttacctccattttaaagccgtgatacttccaactgcccttttttcagtaagttcttgttgactactctcttgaaaccaaaagatgcatatcccgttgtacagggggtcaaaagtgtgcccaattaagcctgccttgacttcaatattgcaactcactgaagacacacagtggaatttctggtggaccccttcccataacccacagggaactctagccgtacatgggtcttactgacccgttgggtctagctgacggtgcctgatggtctccaatgaccaaggtgtcctcattagttctgtgctatatttagttaagcctgaaatctgtgcccctaatttaatcacacaccaggtagccatggagatgacatcaagcctctggctgccctataaaccattgcaaatgctgaaaataaaataaacaggatatgcaaattgacttcctaagtaaataaaagactttgtctccaggtgttgggattagctgcttttggttcactgatgtttgttaggattcacagtgatttgaaaaatatcatcgtaacagcctttgtctcaatgcctaccttttttcctttttgtctgttgcagatatatcaacactcgtatactggatattacgtcctgagcaaaattcctcatgggtaagagtgttcttttctttcttttaattagaaatatgcagggcaaagtgaagggtagaacatggacgagctgtttaacccttagggcgggaaatggcgttccagttctcacagccaagggtgctggtatcgtggcacctctgggactctccctagataatgacactaaggatgtcagggggtcacttgagtccactcacttccccatttgtgaagcccccttcctagagcaactctgccctcttcctgtgctggttcctgcagttgaccctggaggttcttcagagccggacattcccctctgctttgtaatcacctgcagcctcctctcaggcaaggtgaggtggcccttggcctcccacgagggttcctggttatacccacactagcagaatagaagcctctctcagcccaccacatgtcatcagagacaaatctggaacatatctatgggattacggtaaactactctggtcagacattcagcagtgcattgggaatgggttgggcaagtggtattagtgctgctctacccatcactccgagggggtttcagcggcgtgttgttcttgttttattgtcctttctgagcttggctgtgctcccagggccgggtttcagtgcctgcttttgactgggccccccggcttcattctttcatgacctcacattgcactgctaacctcatctggtctctcaataatgtattgtccagagcaggagcgagtttagttttcagtgctgggcaggcgtcccccacacgaccctcagatgcctgatcagcttcacctttggaacccagagcagaaaagacattggttagggtttggtgaaaccacatgttgagtcagacacagatgaaaaatggttgcagaactaggaaagtctgtcgaggagaattttttgttgttttatcttcattatttcttcgtctcctcttccctcctccttccctcccctattctcattcccttctcctggccttcctgttccccacctcatgtttctctttcctgtcttctgtggtttctactgtcatgctttgcaaaggtgaggtgctcaggaaaggttgataaagaaactgaattgtgctgcagatagtgtcatgtaggctcctgtgaatatctaggttgaggcatcctcatttcccaagcaaattttaacagcaggagtggctagaaagcatttttccataggtgagcattaatcacagcatgagcgtttatagctgctgctctctgttttctactcagcttagaatacaggcaagtccttggaaaacaaactcgaataaactaatttaatgtgggctttagacaaagggaagacgcatgtggatcttcagcaaattgtgaccaatagtttctgttagattattagaaaagtgaagcccaaagaaagcaaagatggcccaagttgcaaaaataaagtattcatacaaatttttcattaaaagtatgttttaaatagaaacccaaatattcttcagtaaagaggaattatcccattctttcccaagcagatatatatcttcagaggtcatggcaggcaggactataattatgccttgagatttatctgccccttctgggaacaatagaatttgttgtagatgatagatatttcgttccatcttatatcaatttgtaaaactcgaaactctaaaagcagttgatgcctaacgtattgtgttaatattttactgcatcagtcagcatttggaggaaacagattctaggaacttggcacaggagtttgctgaacaagctagcaaagctcaggccatgatagtctgtgttgaaggctcggcttctgcacttagatacctggagcctggtgatgatctgccttatagatgaccccaacacggagggagctgcttctggtgtctttaatggaatcagagcaagaataatgcccctggtttattggttagctttcatatacctttatccctgttcaacaacctgcaagaaaagcatccttatttccattttaagtgagagctccaagaggtcatcaccttcccctcacctcctagctactgtatgcttgagtctcagcgtaagtcaggctgactcgaaatcccatgctagtaaaaaaactcgtggctcacacctgtaatcccaacactccgggaggccaaggtgggcagatcacttgaggtcaggagtttgagaccagcctagccaacatggtgaaaccccatctctactaaaaatacaaaaattagccaggcatggtggtgcacacctctagtcccagctactcaggaggctgaggcaggagaatcgcttgaacctgggaggctagaggttgcagtgagctgagattgcaccactgcactccagcctaggtgacagagtgagactctgtcaaacaaaaacaaaaacaacaattgggattaattcaaaggtcacaatgcagagaacaaacgtgatagctataaagatgagattttttagtgacatactactttctcttcctagggttcttataggattgaaagatgtagcaagtacatttattggaaaacaacctctgggggtgccaaagtcagtgtcccaccctgtcaccatgtcactgaacacagcgcccctgaagcggcgttgctcaacctgctcaattcttcctctttgtcataaggccattgatgagaaattagccaattaattcattgcaaatattgtcagagtcttatttgtcttaatgagacagtggatctctgagcggtatctccgtaggcctggagcttcgtgaccccttggtcatcactgtcaccggtgtgcgtgctccaccaggtggcagaaaaagaacacagcccggagctctaagtctgaggatctaggtgggttttggatagggaggaaagcacaattgtcttttaaaaataaaaatgtccctactaaaatatttgaatatacattattcatgtagaagaaaactaagagattttcttaatttagaaaacacatatctgtacctttttcactaattctcatctttcctttcctcgctcctccctctaaattaaagccagaggccgtgcaatcttcaggatggttttgtcatttatagcttgatttttttttcttagcttcagtctttgcaaccagccagagaaaatggtctaattaatgttctcatgccctctgatttctgttgtccttccttttggcaaatggcaaaagagtttcaggacggactacccctttcccatccccctctcactccccagtccccgctgttagcttccttcctccgatggctgtgacctctatagctggggccaggtagagttctttctgtgtggaaggtgggagttgcaatgagactcccaagacagctgaattttgatataatcaaaaatctattacctaagggtaggtttgtttgactttgacataccaagcttccaaaaattgtattcttaaattgtatcctaaaaggacatatgccttttacaacaaatctatattttagcggaactaaagctagttatttttaacataaagcatttcactagaagtttttatatcagaattttaataaaataaggaatcttccatggtggagtcaaggatctgttaggtgtttccatataagtatttttgtagacttggctactgcatgacattttcctggcatgacttctttttctagaattagttttgtctttatattttttagggtctaaagccaaaggcaaaattatctatatttatgtctattatctatctacctagctttctatctatctatacacacacatatacataatacacacttttaataatagtaataatatatttctaaaatgtagtctcatatccaataggattgttctgaaagacatatggacttttttctataaccgaaatcaatttgaagaaaaattggtcctatcactttattatgtaatgttggcaattaggggtctggcaaactcagaactgtaatagaatagaaactgctgggtgttcaaaggcatttttttacgtgactggccatgttctgtggatattgttgctctaactttgcttacctactcgtaattttcaggcaccaaacaaaactgtgaaaaaattgtgttcctttagaattgtagttgactttttaaagccatattctgtatctgtggaaataggaaactgagacatcacttccttctacctggaactgctctctaagtttatagactgagatccagaggagcattctgtttatttgggaagtagatatctaggtcgagaatgtacagtgcccagtgccagcctaatagcatcatgccaggcagtgacttagaccctgcagccacatagacctgaacttgaacccatcgtgctgctgacttctggttgtgtgaccttgagagttgttctacttccataggtcttaggatccatataagaagatcataataatagtgcccactttggcctggcatggtggctcatgcctgtaatcccagcactttgggaggccgaagcaggtggatcacctgaggtcaggagtttgagaccagcctggcctgttgcaaaaccccatctctactaaaaatacaaaattagctgggcatggtggcgggtacctgtaatcccagctactcaggaggctgaggcaggagaatcgtttgaacccaagaggcggaggttgcagtgagctgagattgtaccattgcactccagcctgggagacaaagcaagactccatctcaaaaaacaaaacaaaacaaaaaaattagtgcccacctcataggcttgttagaagaattaaatggaatggctgggtgtggtggctcacgcctgtaatcccagcactgtgggaggctgatgtgggtggatcacttgagttcgagaccagcctggccaacatggtgaaaccccatgtctactaaaaatacaaaacttggccgggcttagtgaggctgaggcacaagaatcacttaaacctgggagtcggaggttgcagtgagctgagattgtgccactgcactccagcctgggtgggagagcgagactccatctcaaaaaaagaattaagtggaatgatatatgcaaaacacccagcaaagaattttgcatctagtgagtgattagttaatattgtagtatgtacccaatatatatttgtagtcttataattaaatattatcagactttagtttctagccatcttgaaaatcttttctgttacaaatgaaggaataatataatcctaaaatcatacaattctctttaataatttttctaagctgaggcttgtttcatgacactcaggtaattataatgtctttgtaattttaatttccctcttaaaagaagtatctatggcctcaactgtctacaattctcaatactcaataattttttttatatcatctcattctgaccttctgcaattaactttccagcattcttgttttgcctccaatggaagcagaaaagatactgtgtcagcaaatacttattgaaatactgtctggagcaatgaaagcatggttgctatccttaagaaattaaaaatcttgttgcaaaggaaagatacagacttatataataaaatgttataaagtctgttaagtgagtaatttctttttttttttttttttttgagacagagtctcactctgttgcccaggctgaagtgcagtgatacgatctcagctcactgcaacctccgccccccaggttcaagcaattctcctgcctcagcctcctgagtagctgggactacaggcacccaccaccactcctggctaattttttgtatttttagtagagacggggtttcaccgtgttagctaggatggtctcgatctcctgacctcgtgatctgcccacctcggcctcccgaagtgctgggattacaggcgtgaagtgaggatttttaacactacccaccaaagaaggaggggagggttgaaggtgtcaccatcataaacagtctcaagaaggaagtttgacttgaagtgagcctgatagctgagtttttgtttgtttgtttctttactttttaatagatgacaggagggagatactccaggcagggtaaaacatgaaatgaacttgacctttgcatgagccaacacttcctagaattaatgaggtgccctgccaggctgctgctggagtgttcacgtgggactcagcatgggtaggcatagggttaggtaggctttaggaggtacctagagtgcagacaactgaaatactcagtgtttaaaacccagtagtattggtctttacaataagaacatagcaaccttttggagcagaagaggaatgtgatgaaaacagtaggcgcagattagttttgtgcttatgtatagcatacactgaagaaaaaggaagatcaaaattctggattcaattagcagccaggttggaatggtgggtcgggagctcagccaatgtagaaaccacactaattgtgattatgagtagctggtgttctcttggaaaatgaagacagatttcaagtgtttatattccatgtccctctaattaaatctgtggcagcctgggctccttgtgagttgagcctggtgccatcctgagaggtctctctaccatgagtggtctgtaggtagtgagttcaggagggcagcgatgagaattctcagcacccatgttggttagtgcattcctttccagccctttcttcctgtgtgtgagtctccagggcctggctgctgcacacacggagataggctttggctgtgcagagcaagctaccttcacagctgccggaagttacagaactaggattgtgtgtgtaaactggggaagcaccagtgtgaagcaaaaatgcagaagaaatcttaaaatggctttttttttttttttttttaagatacagagtctggctctgtcaccaggttgaagtgcagtggcgcgatctcggctcacttcaccctccacctcccaggttcaagcaattcttctaccgcagcctcctgagtaggtgtgactgcaggtgcacaccgccatgcctggctaatttcttttgcattttagtagatacgacgtttcactgtcttgctcagggtagtctcgaactcctgagctcaggcaatccacccgccttggcctcccaataaaatggcattttatgtgtctgtaccatggcattgaagaggggagaattccactgttacttgctttttttgttttgtttatttgttggtttttttttttttttttttgagaggaagtattgctctgtcgcccaggctggagtgcagtggtgtgatctctgctcactgcaagctccgcctcccaggttcacaccattcttctgcctcagcctccggagtagtagctgggactacaggcgcccaccaccacgcccggctaattttttgtatttttagtagagacggggtttcaccgtgttagccaggatggtctcgatctcctgacctcgtgacccgcccgcctcggcctcccaaagtgctgggattacaggcgtgagccactgcgcccggcctgttacttggttttatggattttcagaactgtgaacaactcatacatctgcctgtaagacttggtctcagccatttctccctccccttctcccttcccctcctgtcctccttctatccctccctcctgctgaaatccagacttctagtaaccatcaccaaaaaatgtggactttagagtcaaggagatctgggcgtaaatccccagtcttcgtttctacttgtgtagtcatgaaacagttcctttgctcctctgggcacacttactccatccatatattagttgcctaatgcatggggtttatggtgaagtttctgtgaaacactgtatgatgaggtgatgtctttaagggcctgctttggttcatagaaaatactgagggttgccaggcgcggtggttcacgcctgtaatcccagcactttgggatgccaaggcgggtggatcacaaagtcaggagatcaagaccagcctggctaacacggtgaaaccctgtctctactaaaaatacaaaaaattagccaggcatggtggtgggcacctgtagtcccagctacttgggaggctgaggcaggagaatggcgtgaacccgggaggtggagcttgcagtgagccgagactgtgccactgcactccagctcgggcggcagagtgagactccgtctcaaaaaaaaaaaaaaaaaagaaaatactgagggctctattcatggtggacaccaagaccttccataatatggccaaatctaattagccacccttcatcaaatttccctaaatttgggacagaaaataaatctcatactcactgttaactctgaccaattgacaatgacttcctggagctctacatttaaaaatagactaaaaccatgcccaggctctttaggaaagaatgccacaatcagtgagttttgcctctgaggtttctattctcccatccggctgtgtaagaatgaatcacatcacgcaatgtgtccagtcattgctcccaaacccggaatgtgtttctggttatccacacctctattgacttcattctcctccccaccacacgagccccctcccacacatgcgcactacagaaatgtcctggtcattgtgcctctcatactcaaatccttctgacccttcaagccacagcgtcaaaacctccttctctaaaaaaaacctgaatgctgagagtcaatactgcttcttatttcacgctagaatttatcgttttgttagatggctacttccattgttgtagatagaatttttctaaaggggatatttaggaatgctttccatatccatgtattgcttgacttctttctctccgtcattctaagttgtcagagagaggggttgggtgggaagggtgtggactctgcctgtaataccagtagctgttgcacagggtgacactgtgactttgaattgcaaaagtggcgaaagaggctgcaccaacaggtcttatgctctttccaggtgcaggtctcagataacaagctgaaggtagtcagtgactggaatgtcatcggccacctgcaaagggagtcattgcagctactcttttcagtggaatcatttagttccctcagggactttcttagaaagtctaaaagattttcaaacaaacaagtctctttgaaaatgaggtgaaaatgcccaggagtcctcatttggtcaggctccttgttcatcttaaactctacacccatgtccctggttcctgatactgggggaccccataaatgttggttaatcactggaggaaatgaattaaggaactaagccatgctgaggagcaagaatgtgtgtgctggggccccaccacaaatgggttaaataagagcctctgaagagggaacctcaggatggctttgaaggctacctgggtgattttggtgtccagctggggtcatctggcctgctcgcccctttacttgctgcccttgacaagtgacacccaggattgccgtggaagctgagaaataacacttctgtctgaatatgccagtaaagtttcctctcaggcattaatttccttgtccactcaagaaacttggagaaataagggtagatctcagattaaccatgttcttggggatttacttaatgatattcagtaaaggggttatagtatcaaagtctgcagcatggagatgaagcagagccggctcttccggggtctgtccacatcaaggggcaccagacgttggttgtgattgttcctgagcctggccaacctcacatgtgccctgggctccctctggtgagctccggtcttcaccttaaccgcgcatgtttgcattgcggggaatctgtgcttcagacagacacgccagatgttacaggtcactgcatctaagatggaaggtgttctgtttatttatttatgttttaattttggctgttgatcactttcttgtgctggtgaatcagcacgcgtgttgaaccagccattaatctcctgggagagagctgttgacatcctggagggtggcactcttcctgtttacagatgttaaagagaaaggcccatgggtgtctccctgggtggccaagcctggttcatgtgtgtgctgtgctgtgtgttccttcttccacacaatcactgagcctggccgggcacagtggctcacgcgtgtaatcccagcactttgggggaccgaggcgggcagatcacctgaggtcaggagttcgagaccagcctgaccaacatggtgaaaccccgtctctattaaaattaaaaaaaaaaaaaaaattagccgggcatggtggtgggtgcctgtaatcccagctacctgggaggcagagacaggagaatcgtttgaacccttgaacctgcgaggcagaggttacagtgagccgagattgtgccattgcactctagcctgggcaacaagagcaaaactctgtctaaaaaaaaaaaaaaatcactgagcccctcgcaagtgccaggcctgatgcgaagcactggggatggatagggaaaggccccacctgtcccttgctgtctagtttattttgttttgtttctacgtcacctcctctctcccctgtgctcctgcagagggttggacacaaataccccactgtgtctgcgctggggacattggcctaaatcaaacatctagggcagcctcagccaggaaagggcatcactcaaggagagggagcaggtcagtctgtctggatagtggtgggaagagcatacaccaacaccaactgtacgtatgtgatttcaagtttattgtggtacaatttacttctaataaaaatcacgctttcggccgggcgtggtggctcacatctgtaatcccagcactttcggaggccaaggtgggtggatcacaaggtcaagagatcaagaccatcctggccaacatggtgaaaccccatctctactaaaaatacaaaaattagctgggtgtggtttgggtgcacctatagtcccggccactagggaggctgaggcaggagaatcatttgaacccaggaggcagaggttgcagtgagccaagatcatgccactgcactccagcctggcaacagagcgagactccatcttaaaaaaaaaaaaaaaaatacactttttaaaggcatcgtttagtaaggtttgacaaataggtgcaatgaatgacataagctccccacaagcaagactcagggcagtcccacctgcccagagcatcctccatacccctccacccaggcgagcgctgccatgccatctatcccacacttttgccttttgccttttctggaatgtcatgttgagggggttgtacagtgtgttaccttctgcagctggcttccttagcataattgcttttgagattcacccgtgttgtgacaggtgtctgcattcatttgtttttcactgctgaggagtggtctgttgcatggatatcataatttgtttcttcattcaacatttcattgatatttgagtgtttctaattcggggctagtatgaataaaagtgctgtgcacatttgcacacagattttcatccaacgtgttttcctttctcttgggtgaatacctagatgtagaattcccagatcataagtaaatgcacctttaactagattctaaagtgcccaactgtcttccaaagtggctgcaccattaagaactctgcctttttcttaactcactaccccaggactgacttttttgaccccctgccctccgcccggtcactgtgtatggcaggtggaatccaccatgccctgggggtggttccacctgcagctgtggggagaagcatctgtgctcactgcacatagatctgtgccctcaatgccagcctgcacctgcctttctctacctggcacctggggcctcatgggggatggtgtccggcctgcaggagcagcagcctgactgtgccatctctcatctctccaaatgatctctctgtggaactttctaaatgacatatcagccgcgaagacaaataggaaataagaggcaggaggcaagacagacactccccatggagcggattccacgtggccctgggcactcacctcaggagtggttgagaaagcctggttcctgcttgctccatgaagtcctcactccttgaccagattttggagagaggaaggtttttcaataactgcccctcttggtagtcctcctaaggaagagcaaaagaaataaaacagattcaaaactgtgggcctgcgcagtgattcatgcctataatcccagcatttggggaggtcaacgtgggaggatctcttgagcccaggagtttgagaccagcctgggcaacatagcaagacacccatctctacaaaaatacaattaaaaaattagtcggatatggtggcacgtgcctgtgatcccagaaacttgggatgctgaagtgggagaatcgcatgagcccaggaggtcaaagttgcagtgagctctgattgcaccattgcactccagcctggacaacaaagcaagcaagaagagaggagaggagaggaaaggagtggagaggagggcagaggaggggaggggaggggactatgcatatcccagtagcctggctctgggctgggtctgtctgttgcttaaaggcttaaaaaaagagcacagagccatctgcacttggacatcctggtgacgtggcctaacttccgacattggggtcctgtaaaagaagataagccatggtgtttccttaatgagaaggccttaattccaaagtgagggctggcaaacccaacagcacagcactcagaggagaagacacagttgttgattgagtcgagctgtctggcttcccaggaccctcagctcagtcacagcacagcgttaccaggatgtcagacacccaagggcagtgctgacatgcagcctgccactgtggccacagcactcgggttaaaaagaaaccagataaaattcgtgtttctgcttgtccagactagaaattaattcaaacctggcctgtagcagctgtcttctctacatccaactggatggatgaaggccgtcctacctagtagagggaggttggaaggatgagaactgtctacaattaaccttttcattagcacagaaaatttagacaaccaaggtcccaatttctaatgtaaaggtcaatttcttacatctctgtgtacatcctaactgattcaccacaccattgcccgaaggtacatttctattggttttttgaaatgctaagaggagctctcaggcagtgttaatgtatgcactcacgacttcataggtaccagtactgcactagcttccagtatagcactaggtactagtactgcactagatactagcactgcactaggtactagcactgcactaggtaatagcactgcactaggtactgtggatttgaggggtcagaggggaaggaaaccattctgattgtcaaggaatttcctatatagttacagaaaccacattcattagagaatgagtaaattacctttgtgctcctattagactacataagaattgtacaatgtgatgtcctggggttacataagtatagttttaaatcaactatatctgcagcctgtgaaaaacctattccccttttttcctagttgcagttcactccccagttcgtctgcaccctacctcgatgagatctccccttccgtgggctaaacaaaaccccaagcagttagctgttaatgatacgagcaccatgccggagctagggccaaatgagtcagaagaatcctttgcagtgccgcggggccctaattgtgtcaggtattttgcccaaattagcatggctgaggatcggctgctggttctaaaatagtctcgaaggactgtctccaaattgcttcggcaacattactcattctcagcacgactctggtttccgccgtcccaatttacagatgggcagccgaaagggaaaggatgagatggctaaactgaaagtcacaaaggaaatcctgggccaacatcaccccttggggcttcctccagctgcggtctgtgcccccacagccccaggatgctgggcggttttctccaagaattggaaaccttttcccagggcatcctcacacaaagccccactctgaataacacgatgatttcaggcctttttctaatcataagcccccaaattagataagatcaacatgaaaggtctcaggtatcccttaagaatttaaaggaaggacagaaaaggttgagctctgtagtgcgtggaagaggagatggcatgatcaggatactgtcctgagaattagcagtaggatcttacagtgaaatagggggctcctccgcaggctcccaacacatcagctggtaattatgcccggcaccaggatactggggcaaggcagagccactggaacacatcctcgcctgcaccctgctctgctcattagccatagcatcaaaatcacttttgctccaaaggcgttttttttttcctatactgtacattcttttgtgctttctaatttattactttttttcccctacctgagctgttggagatttagtgttgaatggcttctctgtatttttctttagtctaattcattatcactaagtctgtggtttttttttttttttgtgatcaatatacacacttagattggtttaaaataatcccatggagagcctcattagtgtccttggataatagatgcagctctctgggagaagggagcgtttatcagggaccacagtgacagagcccacaagcacacctccctgtgtgtgtgttgaacatgctagaacatgcacatgtatgttgtcaggtcctcaggctgcatgaagctgctacatgtgcaccatgtccctgctgcgtccctgctgttcgttctgagcactgtgagagcctgaggcgtcagagtgcagctcattgagacccagacgccactagattctcagtcttctgcatgtttttcacacctcttatgtttactgaaactacatcttgagctgagtgtttgagcaatttgttctcaaggccaatatgggcaaactccctgagtcggagctgataccagcgaacggcttcagaaagtaaaaaacatgggaaagaggctgagaggaaagaacgctctgagtgggaagagaggagggagcacctgtctgaactggctccgttcacgtccattcattctttaaggaacttctctttgtccttcataaactacagtgttcccctgtctcccaggctggggtctcatggctcttgccacaggccaaaaagaaataagatttcctcttggcaacattttttgttctgtaatgggattttactgaaaggcaggaggaaaaagcccttgaggtgaccaaaaacttgtttttaacacatatgatgtaaggtaaaagctttaagaaggtaaacagagctgggcatggtggcacatgcctaacgccccaacagctcgggagaccaaggtaggaggatggcttgagaccaggaggttgaagctgcagagagctatgattgtgccaatctactccagcgacagcatgagaccttgtctctaaacatagatagatagattgacagattgattgataaatgatagatagatgatagataaatgatagatagatgatggatagatgattgataggtagatggatagatgacagatagacatatagctagatagatcaatccatggatgatagatagatagataatagataaataggtagatagataaatgatagatagatatagatagataataaatcaatccattaatggataggtgatagataatagactgattgattgatagatgatagactgattggttgagagatgattgatagatagaaaacaaacctgttttttagtttcttcacagagtggcacaagcatcatctcattccattttagaacattccacccccacctccaaattatgctttagcatttactgaaccccccaaactcatttctgcttccccgtcatgtcttcatttcacagagtttgttgagcactgatcttgatattaggtttacagtgacagagaagacacaagctccctttaattacaaagattccatttccgtgtgactgtgtttactacggtcagccctccatatccatgggttctgtatctggagattcaagcaacctccctcaggtcaaatacctggaaaaaaaaaaaaaaggatggttgcatctgtactgaatttgtacagactttcttccttgtcattattccctaaatgatacagtatcacagctgtttacattagcaattacattgaattagggattataagtagtctagaggtggcttaaaggatacgggaggatgtgcttacattatatgcaaataccacacattttatatcaaggacttgagcatctgtggattttggtatctgcaggggtgtcccggaaccaatcttccatggataccaaggatgactgtgctcatatttgtgatcatatatgttaaaagcatctctctgaattagagagggaatctgtcacatctgtcactaatattttagaacaggccaccccgatccatctttagtgagtggagcatctctgcctgaaaacatctatatccaaatctttctttctttctttctttctttctttttttgatacagcgtctcgccctattgcccaggctggagtgcagtgacgtgatctcggctcactgcaacctctgcctcccaggttcaggcgattctcctgcctcagcctcctgagtagctgggattacaggcgcatgccaccacacccagctaatttttttatttttagtagagacagggttccaccatgttggtcaggctggtctcaactcctgaccttctctgatcctcctgccttggcgtcccaaagtgctgggattacaagcgtgagccaccgtgcccggcccaagtgtttcataaggaaaggaacttctgatacaccatagagtgtctgggaaaattttaaaattactaatggaatatgtgctcaaatattggcccctgaggaagcatttatgcccatgaggattcctgccctcaaaaatttaactgtgtcatttagatatacacaaaaaatgaatatatatgaatatttaaatgctacatgagtttaaggtattactgaccctagccactcagtgactggagattagactagacccacttattaatccacccatccactaattaattattcaattaatatttattgagcatctaccatgtgtcaggttctcttttagaactgggagtgtatcacacatttttatattaccttccatgctaagtacataggaagactcagaaaacacatatgattagacactgagaatgctattttttggtgcctttggtgataaaacgttaggatccaggaaagcaattgttaggtttgccccctcactcccaaatgctgttgctgttataaagcttttcagtccctcaaaatcacttaggaagataaatgagtaaacttcgctgcactaatttactcttcaaatttcagcatgatttatgccctgttttgtttattgctcaaataagcaaaatcagaatggattgtgtgattattttgaaatatagttaagtccagatcactttattcttccttcatcatttttttttaactaatccatctctacccaggagatgattcatcacacagctgccagggctgctttaaaataaaggaataaataagaagaaagaaagaaaagtgaaggagggccactacatagccccaaagtaaatcactgtacaccttcctgcattctctttctctctgcctgtcttcctctctgtcacacacacacctctaagaatttcagcagaatccgggacatgctggaaaatcatttgatgcgaggaattggggcttaagccaagtgtgctgccgtggcctaaatgtgcaaggtggggccagggacttctcccgcaggaagccggctcaggccagaagcccagggggtgggcagggcaggggtcatctcccccagggtttgcctctgccttgctctctgagggtctccactttgtcccttcaggctttgactaaatcttcacgcagacactggtcagctacctggccctgagcaagtcgctttgggccttggtggaactgggaaatgaagggacattcgcttcctagggctgcggtgagaaatcgccacaaactgcgtggcttaaaacaacagaaattgcccctcccagttctgaaggccagagatgtggacacagttgaaatgacagtgacagagaagggtgtggaggagaggagcggggctgcggtcacgcccaggacactggattttaaagggtgggcagagaagatcccacagagacgaggaccagagagggaggtggggggagagctgggagaaggggcagtcgagagggaggtggggggagagctgggagaaggggcagtcgagagggaggtggggggagagctgggagaaggggcagtcgagagggaggtcgggggagagctgggagaaggggcagtcgagagggaggtcgggggagagctgggagaaggggcagtcgagagggaggtggggggagagctgggagaaggggcagtcgagagggaggtcgggggagagctgggagaaggggcagtcctgaacatcaagacagagaagcagcagccgcagcatgtgcagggagagaccacccaggcccagcacggggaggccacggactttggcacctcgatggacacagaagatcttcagagaagcaatttcagctttaaaaatggatggaagccatattgcagtgggttagggacaggagagaaggtcagaaagtggccctcagatttggaccactcactggattggaccaagaccggtaggcgttgggctgatgatgggttagaggctgcgtggggaggaggtgctcatgggtgggtggagaggctgcgtgggaggaggtgcccagagatgggtgagaggctgcgtgggaggaggtactcatgtgtgggtggagaggctgcgtgggaggaggtgcccacagacgggtggagaggctgtgtgggaggaggtgcccagtgatgggtggagaagctgcgtgggaggaggtgctcatgggtgggtggagaggatgcgtgggaggaggtgctcatgggtgggtggagaggctgtgtgggaggaggtgcccagagatgggtggagaggctgcgtgggaggaggtgcccagagatgagtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggagatgctcgagtgggtggagaggctgcgttggaggaggtgctcatgggtgggtggagaggctgcgtgggaggaggtgctcatgggtgggtggagaggctgcgtgggaggagatgctcgagtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcatgggtgggtggagaggctgcgtgggaggaggtgctcataggtgggtggagaggctacgtgggaggaggtgcccagagatgggtggagaaactgtgtaggaggaggtcctagttgtctgcatttcctttgggagaacagccttagggaaaggaaagagactggtggagcaaaatccgagaggctgaggcagcataaaagtctctcctccatggaaaaacttggagccaaaagcgcacattcctcagtgaaagacgccaacctgaaaggctacactttgtatgattccaactatgtgacattcaggaaaaggcagacttatgggggccttaagcagatctgtgcttgccagggtttggtggggtgggaaggatgaatcggccgagcacacagaggtttggagacccaaaagacgtctgtatgatcctgcaatggcaggtgcaagacggatggatttgtcacaactcacagaacacacaggcaaagggtgaaccctaatgtcagctgtgggacttagttaataatgtttcaatattggtttatcaattataccacatgcaccacactaatgcaagatgtttgtaatttggaaaactgagggcaggggaagaaggaggatatgggaactctctgtagttctgttcagtttttctctaaacatgaaactgctctaaaaatataaagcttattaattaaaaatagtaataaataagaaaagtttaccaggaaggtaaatggaaagtatttgatagttctaggatggaacaaaaaaggaggtacaggaggaagtgctggccgagacggaaaggggatgcctggtcattggagactgagaggagggaggagcaccaggtacttcagtgtgtccgggaggaagccttctgcagggaagcagggaccctgggccaagctggagcctcccagaggcaaaggctgagagtgaggctgatggagagggaagccctgtaggcaaaagggagagggagtgggtgtgggagggagagccttcagtgctcctctgtctgccccacacctccttgtccctttagagtaagggggcagtaggtacaagagagatgtaaggagagcaggaaagattggaattggcattgaggacagacgtgtctcacactctgggtggttgtgatgatgggaatggttagtggtcagctgaggttggagacattgcatttgtcattcccaaaggtcattctcaaaggtcaaggtgttgatgtggaggaggtagattcggcataaaaccaagttgggcattcgctagtctgggcagagaaggagttgtgtgaggaaagccattcagtaggggattggagcagaggatgaatgaccaccaagtggctcatccaaaagggaattcccacagtggagaagaagttggaaaagtcactctcaaatcctcttttaacttgaaaggaaaagaatctgataccctgcaagaaatcaaattccaatgcaaaaatataggttcctttcataggaacagatgtggagaatatgattgaggattgagaccctaaacccagtttcccacctgacacagggattgagcccatttgtttttgctacagagttccatagagtaaacttgtcccaatatctgacatattactgggcctttaaaagaaattacatatagatagttgttgtaataacattttatcaatattcaaccattgatccttcctaattaagtgaagggttaagggaacacacatatacatctacacattcacatatatacgttgtgtgtattatattgcatggtcaaattatttaccagtttatcaatgaataaaccagcatttatggaatatctgctaggaagctctgtgctatctattttcacatacaatagattattgcgtccaaccctacgaggcaaacatgattattttcattttatacacaggaaacaaacttggatccagttactctattgcctcaagccctttgcttctagtggcagagttcagaattaaatttacaccttcttggaattatctccaccacttcacaacttcctccccacgaggaacatcctggtgtttttgaagacagattgccacgactcacttctggcatcttggagtcacttgtttaacttatagagactgagaaagattgagaggttgagagagtcactagctagcaaaaagaaaacaattacctctttggactatggtagagtttataaattaatagccattgtttctcttgattttcatgaccattctgtaggacgagggtagctattgtccccataggagaaaataagacgcagagagttgctgaaggccgtgtgatccacacgtcataaggttgggactaggatgcaaacttttgattcctggtgtggatctatggaaactcctgtaacgtgttggtggtgagggaagggaaatgcatcttagcttatggaagaagtaaaggactccttgagcacaggtgagccaggtaataaaagtggaattagtgaatcaccatcgcatattggccctagtgttcatgcagtgatggtgaatcaccatggcatattggccgtagtgttcatatagtcatggtgaatcacgatggcgtattggccgtagtgttcacgcagtcatggtgaatcaccatggcgtattggccgtagtgttcacgcagtcatggtgaatcaccatggcgtattggccgtagtgttcatatagtcatggtgaatcaccatggcgtattggccgtagtgttcatatagtcatggtgaatcaccatggcgtattggccctagtgttcatgcagtcatgatgaatcaccatggcatattggccgtagtgttcatatagtcatggtgaatcaccatggcatattggcgctagtgttcatatagtcatggtgaatcaccatggcgtatcggccgtagtgttcatatagtcatggtgaatcaccatggcatattggccgtagtgttcatatactcatggtgaatcaccatggcgtattggccgtagtattcatatagtcatggtgaatcaccatggcatattggcgctagtattcatatagtcatggtgaatcaccatggcgtattggccgtagtgttcctatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtattcatatagtcatggtgaatcaccatggcatattggcgctagtattcatatagtcatggtgaatcaccatggcatattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggcgctagtattcatatagtcatggtgaatcaccatggcgtattggccgtagtgttcatatagtcatggtgaatcaccatggcgtattggccgtagtattcatatagtcatggtgaatcaccatggcatattggcgctagtattcatatagtcatggtgaatcaccatggcatattggccgtagtgttcatatagtcatggtgaatcaccatggcgtgttggccctagtgttcacgcagtcatggtgaatcaccatggcgtgttggccctagtgttcacgcagtcatggtgaatcaccatggcatattggccatagtgttcatatagtcatggtgaatcaccatggcatattggccgtagtgttcacgcagtcatggtgaatcaccatggcgtattggcggtagtgttcatatagtcatggtgaatcagcatggtgtattggcgctagtgttcatatagtcatggtgaatcaccatggcatattggccatagtgttcatatagtcatggtgaatcaccatggcgtattggccatagtgttcatagagtcatggtgaatcaccatggcatattggcgctagtattcatatagtcatggtgaatcaccatggcatattggccgtagtgttcatatagtcatggtgaatcactgtggcatattggccgtagcgttcacgcagtcatggtgaatcaccatggcgtattagccatagtgttcatatagtcatggtgaatcagcatggcatattggcgctagtgttcatatagtcatggtgaatcaccatggcatattggccctagtgttcacgcagtcatggtgaatcaccatggcgtattggccctagtgttcatatagtcatgtgaatcaccatggcgtatcggctgtagtgttcatatagtcatggtgaatcaccatggcgtatcagccgtagtgttcatatagtcatggtgaatcaccatggcgtatcggccgtagtgttcatatagtcatggtgaatcaccatggcgtatcagccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtgttcatatagtcatggtgaatcaccatggcatattggccgtagtgttcatatagtcatggtgaatcaccatggcgtattggccatagtgttcatgtagtcaagatgaatcaccatggtgtattggcgctagtattcatataatcatgatgaatcaccatagcgtattggccatagtgttcatatagtcatggtgaatcaccatggcatattcgccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggtatattggccatagcgttcatatagtcatggtgaatcaccatggcatattggccgtagtgttcacgcagtcatggtgaatcaccatggcgtattggcggtagtgttcatatagtcatggtgaatcagcatggtgtattggcgcttgtgttcatatagtcatggtgaatcaccatggcgtattggccgtagtgttcatatagtcatggtgaatcaccatggcgtattggccatagtgttcatagagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatattctccgtagtgttcatatagtcatggtgaatcaccatggcgtatcggccgtagtgttcatatagtcatggtgaatcaccatggtgtgttggccctagtgttcacgcagtcatggtgaatcaccatggcgtgttggccctagtgttcacgcagtcatggtgaatcaccatggcatattggccatagcgttcatatagtcatggtgaatcaccatggcatatcggccgtagtgttcatatagtcatggtgaatcaccatggcgtatcggccgtagtgttcatatagtcatggtgaatcaccatggcgtatcggccatagtgttcatatagtcatggtgaatcaccatggcgtattgggcgtagtattcatatagtcatggtgaatcaccatggcgtattggccgtagtgttcatatagtcatggtgaatcaccatggcgtattggccatagtgttcatgtagtcaagatgaatcaccatggcgtattggcgctagtattcatatagtcatgatgaatcaccatagcgtattggccatagtgttcatatagtcatggtgaatcaccatggcatatcggccgtagtgttcatatagtcatggtgaatcaccatggcgtatcggccgtagtgttcatatagtcatggtgaatcaccatggcgtattggccgtagtgttcatatagtcatggtgaatcactatggcatattggcgctagtgttcataaagtcattgtgaatcaccatggcttgttggccctagtgttcacgcgatcatggtgaatcaccatggcgtattggccctagtgttcatgcagtcttgcaaggcactgcatattatttccagttagcatttatgggaatttacatttgtcgtatcaaagaaaagttaatcccctgctgtttctgaatatcttagatacctactgaaaatcataatctaacaaactgaatttcaatattaagtaaggcaatggagtttaagtctttctgatgtcccactctgccctctgtgcttagaaaattccaaataaacacaggtcaagtgaatttgttaggcttgtctctaaactttcaaaaggatctttgctgagagccacctctcgaacctacctttatttactaatttatttgtttgttcataggcacataatgagggcctgtgctgtgctccatatggaattctttttttttttttttcagtttttaaaatcaagatcacagtatgttgggagggcaattatctgacttttcattcctatttaggataatttttaaagccaatgagatataagctatgaaattctttttaaaaactttttattttgaataattgtagacacagaaaagttgcaaaagtagtgcaaaaaaatctcccatatttctcatgtcaccactcctagtgatagcatattgtataactttggtataatgatcaagaataggaaattaacatgggtgccatattgttaactcatctacaggcctcatttgaattctaccaatttttctaccaattttctacctgtgtcccaggaccccatgctgcctttagatgttctttcttcttagcaccctccagtctataacatttcctccatttctccttgtctttcatgaccttgcacttttgaggaggactggtcagttatgttgtagtgtccctcaatttgggtttttcccagtgttttctcatgattggagtaaggttctgcattttgggtaaaaaatatcacataaatgattatttgtccttcccattgcattatatccaatgggctccagtgatgttggccttggtcatttgcttaagtggctgtctgccaggtttccactgtaaatttgatgatttgatttatttaattatttatatcagtaaagactcatgggtatttattttattctatgggttaatccagtactaacattaatttttgttgttgttgatcaaactgttctagtatgagtcattagaaactcctttaggttagctttcatgttctctcaataaacccctatttttttagtattccattgctttctggtttcctaaaatattcctgactcattctgtattttccctgccccagcccagatacaattgctcctcccagaagccctattttcttttactgggtgatggtatttagacaccaagatctgggtgctaactgtgctcattgctactggggtgtcattgtttctaggccttctcagtggacagacgcaggacatatttgtatgtatactaacccatggacacacacatatctatattttggatctatctgtgtacatagagattaaaaaccatgagtttatacagatacctctgatttcaaacttcacagtttattttagtgttccccttttccttataacgttttttttcaacagtgaaaaacctggctttcattatctccaatatatttacatatttgtcccattctagcatgcacacagtctcaaaattgatcctccaaacccctgggagaaacaaatttactcacggaactacagagaatcttccttctctcagcagtcccatctttccaccctatttccacctataccctataggtaatcaatctggttcctggtttctgcttcctacatttcctttttcacaaaagactcgattcatatatattctcatatccctttcttctatgatatataattatatcatactatatacatacatatatgtgtgtatatatatatatatatacacatatacatacatacatacatacatacatactataacacatactcttgggctttgttaactctgacatggaaatcactccatatctgtttatagagttattcattctctcttacacctgcaccctacttcattgtattgggggggtatagttttggggggttttataaattgacaaatgataattatatatatttacagggtacaatatgatattttgttatatgtatacattatgaaattattaaatcaagctaattaacatctctatcacctcatatacttatcttttttcattgtggtataatagttaacatctattctcttatctattttgaaacatgcattacattcttattaactataatcaccatactctgcaacagatctcaaaaacttattcctcctgtctaactgaaactttgtatctttttatcagcacccccccaatccctcccactcccagcctctggtaaccactactactctactcactgctcaatactattcagccttaaaaaagaaggatgtaccgtcatttattcaaccacatattgtttccaatatttgcaactacaaataaaactgcaataaatacaaacttgtgcacatgtatttgtgcattgtttgaggtgaattctctaggagtctagaagtggaagtgttgggctgaaagttaagtgtgtactttattaggtattgtcagatgtctctctgaaatgattgcaccagcttgcttcccgacaagcaagtctgagagtgcctgtttccctacagtctccccagcaccatgtgtcatacttttttcttctttttccaagtctcataggtgagaaatgatatctcaattaattttaattcctacttccttaatttcatatgtatttgagtacctttcatatgtttgattgagggccatttttatgtctttttgtgaattgtctgttcatgtctttttctcatatttttatcttttttttttataaccacatttttcaaagtattttgtatgttagggatattagccatgtgttgtaaatacttttctcctggtttgtaagatgtcttttgtttatgatgcatctgtcatgcaaaagttttatgtttttatgtagtccaacttattaatcttaatttctggctcctgaattttgagtcatcaaagcttttctctacaccagggttcaagaggaattaacctatgcttatgagaatactttgaaacatcataacatacaaatgttggctgggcacagtggctcacgcctgtaattccagcactttgggaggccgaggcagacggattccctgaggtcaggagttccagcctggctaacatggtgaaactctgtctctactaaaaatacaaaaattcgccaggcgtcgtggcaggtgcctataatcccagctacttgggaggctgaggcaggagaatcacttgaacctaggaagcagaggttgcagtgagctgaggtctgccactgcactccagcctgagcgatagagcaagactccttctcaaaacaaaacaaaacaaaaccacgcaatgttaaaaactcatctattaacagaacctgcaatattaggactcgcttgcatcttccgatcactgggcagctgccttcccagctggtttctaagcggcaatgtcttctctgaattggcatcgtcactctaccctcaggcttcctggcttctccaaacccagacacttcatctaaaactacctggggcattctagactctctagcctcccccatctgtctttactctaaatgtagtccttgtttttcctggtagttttattcagccgttgcttttgtattttctattgattccagtccaccatgtccttagccccttcaccttccttcccttcctgcctcatctcctttgttcatgcaacccctgaagtgcagcatcctccctttccaaaggccattcaaccatttctttctacagatgagtgggtgcattcccagctatgtgtatattttatatatatatatatatatataatatacacatttttttttcaagacagagtttcgctctgtcacccaggctacagtgtagtggcatgatctccgctcactgcaagctctgcctcccgggttcacgccattctcctgcctcagcctcccaagtagctgggactacaggcacccgccaccgcgcccgactaattttttatatttttagtagggatggggtttcaccgtgttagccaggatggtctcgatctcctgacctcgtgatcgaccgcctcagcctcccaaagtgctgggattacaagcgtgagccaccgcgctcagccccacataagaaattatagctaagtgatagggcgcttacctgacagagcccagcagactcagcagaacacagatatcattcttcacgtggaggggtgtcatccaaaagaaacatgaaaatgaatcttttctacacgttggagacagcagtagctacaaaatatactgaaatatttaatacttataaaatgttagcacttttcatttttcccaccatgacctttactcactataacctttaagtacttagagaggtttttgttgtggtggtattggtatttaatcagtacattaaggataaaaaatataaggaggtttgaaaggaaatacatctttcaatttatccccttcctccctctctctctcgacttgtatctgtcaacacaaaccaacacaaaacctgatgccaccaggtttgtaaggtcataatgacctgcgttatacctagaaaaaattatcttctaggagaaccaaagatggagatacaaattgtggaggtagatcactgcatggttctgcattttaatttttaactttgactgttctggagatttaagaagttgatccaaagacctcactgcatgtcctctcttaatgagtatttactatttgggttaagcaatgatggacctatttcagcttcatataaattatatacatctgaagaaacctaatagagactaaatgagacatattacttagtaacacaagagacaagctcttgaaatggataccatggaaggagaaaggagttaagttataggtaggggataaaattgcagcagcttaaattcttggttcccaacattttgctttgtttttgtttgtttgttcaattttcagggatcctcaaagtctggacccaccagaagtcagcaatgcaaaacttcagtatgcaggatggggccctaaaggccaacagctggtaagccaatcaagttcagtaactatacttgggttttgaggaagtttctgttttctaagctgaatggatctcactgtactcagcctgtacatggtgttgtgtgtgtgtgtgtgtgtgtgtgtgtgtaaattaaaatctggagaggtacaccagggtgtctgaatatgtaaaagggtcatttctttttagatagcaaattctcctaaaattggaacagcatgtgcttggttcctacatctgacatggttaaagtggtgcctaactgtagctgtgtctatggactccagatgaatcatgagctcaaagagatcaacttcattaaaagaactgcagatgagaatgatccgaatgattttgtcatctaaagatgctctgggaactcagacttcttcctgtggagggtttttttttgttttttgtttgtttgtttcttttgagatggagttttgctctcgttgcccaggctggggtgcagtggcacgatctcagctcactgcaacctccacctcctgtgttcaagcgattctcctgcctcagcctccccagtagctgggatcacaggcgtactccaccacacccgactaatttttgtatatttagtagagacagggtttcactatgttggccaggctggtctcaaactcctgacctcaggcaatccacccgcctcagcctcccaaagtgctggcattacaggcgtgagctaccgtgcccagcctctgcggagggttttttaagcaagtagatttgctggccctgatggagccaggccagtcccgtcaacatgcaaaaccccccgtggtcattgcagccttctcggtttctatcagctatcttcatggattccttctcaaattggcaaaactgctgggtttctgtgaatgggaaggacagtgcagagaaaaaggccctgaacactatttctaagatgagggctcccaccctggttctcactgccgagctggccttggacagcacctcccgctgtcaggctgtaggcagcagcccagccatgtagtgaagaatttggataatacggtccttcaggtttgttccaactctagccttgcgtttgactaaaacttggttatatttgtccattctgggtaacatttttttaagacattgtattgccacgtgcagaaagtccctcaggtttgaaggtcagatgacatggttgctgttttcaagtcaccattttcttctgcctctttaagctgattacctaagcctgcatttgtaaagctcctttttcctaaaatagcacaaaaaatgatcgtatctaaaagctcccacagaattgtatcggataggctgtcatctatcttacaaatgaaaatagtcttatttctccccatagtacaatcacattttcttggttatatattaattccactgccttgaattggtttgaaaaagcaagaagatcgaggcggtgaaactattaatattttagctattattaacatgtctctaatgctaaaactgataacagaggttttgaaaagcatatgtaactgatcaaaatcacagggtgacaggaggaagtgaggcagctgagagctgaccttgaccgaggaacaccaatccatcagttcagtcacaacaaagagacaaaatttgtcttttctcaaaggcattaactcttacacagggaaaaaaatgcaatttgataagagattgtagaagatctaagttttcaggactgatgcgcaactgaatctctaatagttgactttaaaaccctctgaaagtctgtgattgaagagattttcaatatccatcaaatcatctgtgaaagtggccattacacctccatagagagctctccctgcctgctgcggatccattacaagccagtacccacagctctgcacctggcctcatcaccccactacagggagaaggatgggaatgtgtaaccttactgagtgatcattgtccagcctttttatagtagtcaggagaagaccatcataatgtgaccacatgtcaaggtctctttccaccatacctgcggcctcgcttcttatcacccagcggctgtaactcagtgtgtggactcctgcctcattgtctgcacatgcaaataaaccgggtcccgtagtagagttggtacttgtcctgcctctgggaacagcttgtaacataaaggaaatttaacccacaactgtaaaaggagttgctgtgcatgcatatgtgtgtgtgtgtgcgtgtgcatgcacacactttagaattaagtctataattgtcctcttgaacaactgaccttcactcatgtcatgctccgttggagatgaggaggggataagtgattatagaagttatcttgtttaacctcttacagaataagtagcaacaaaacaaagtaaatgacaacttctcagagaaggcttcctgacacctcccccaacacacacatgcacacacacacacacacacacacaatggtagctagccatcctggggcttcaggtttcaccgtgcaatctcccagcacacatgatctcttgttgcctgtagacatgtctctctccttggttaggtggtgatatggtgtggctctgtgtccccacacaaatctcacctttgaattattataatccccatgtgtcaatggtgggaccagatggagataattgaatcatgggggcagtttcccccatgctcttctagtgatagtgagttctcacgagatctgatggtttccccctttgctcgacactcactctgtcttctgctgccctgtgaagaggtgccttctgccgtgattgtaagtctcctgaggcctccccagcaatgcagaactgtgagtcaattaaacctctttcttgtataaatgactcagtctcaaatatttcttcatagcagcatgagaacaaactaatacaggtaccctgagtccacacagtgagactgtttcatcttcgtattctaacacacccagcacagtgtctggtgcccagtacacatttgttgaggtaaaagatgaaagcacaaacagattgattaattcattagttaatacatttttgtggtttcaaaccacttcagcatgaagaattggatggtggcaaatagccagcatctatgaatatgttctaggacagtactagaggtgacagaaatttgacttcctttctgcttcaaagaaatgaatgttcaggtaagtaataactgttaatacttgagtttagtaccaaaggtgctatatacttgtggaacttttgagtttttaaatccatttgacctttaagagcgttatgatacatgcatgtactgagcttaagacgcaatatagctcattgttgagtgagtaccctatgtgctggagcaggggccgccttcttctgcagaaggtcagatagcacatgtttcagtctttgcaaacagatagtttctagcacaatgactcatctcccttactgcagcatggaagcagctgcagacagtatagacaagatgggcatggctgtgttccaataaagctatacttcccaacacaggtggcttggcctatgggttatagtttgctgacccctgttttaggggatcatatgctgtcttggttgttctcatggggaaagcctgaccccagagccaccacctcatcacaggtactccccacacctgctccgtctgcacagaaaattcacaactcaagagcaggccttgcaagccctaacctattaagtgatgccaagcaacacacccctcattgccattttattttaaaaagtaaatattgctccctaaagtcaacctactctaattataatgagtcagattgaagtgagtaattctcctttgggagcagagaacacagctgcagttgaggtttgcaaagagctttgggaacatgtagcctcctgtgctgactgatttcagtgatgcctttgggtctggagcccctatatcacaggtgatgacccagggaaccagggatgggtgagggcatcttttcccagtgcctcgatgtggttgccaattagctcttaccttttagagtaagtgttgtgagacccatagaacatttctccggtagtaatgactgcagggggagtggcctgtgtgttgttagtggagtgggtgggaggaggcccccaggctgccagaagccacttctgtgatgatgctggtctggggctggagtttatgacaaatgacaagattgcttccaaacgtttgctgaggacccaggatgtgatctaggaaatagacttggccagattaaataggattaaatgagaaatcctaggtaaaatgttaacacagtgtctctcctttgcttcctcttcctccaaactggagtggtcagtcgggaaacataaacgttcaaaacatatgctgtttcaacgtatttctctgtaccacttctttcctcattgtgtcctcttcagatgaatctgcctgaactgagatttcctccatgtttctttcttttttttttttttaactggaatctccctctgtcacccaggccggagtgaatgttgcgatctctgctcactccaacctccacctcctgggttcaagcaattttcctgcctcagcctcccaagtagctgggactacaggtgtgtgccaccatacgtggctaatttttgtgtttttagcagagatggggtttcaccgttttggccaagctggtcttgaacccctgacctcaagtgatccacccacctcggcctcccaaagtgctgggattataagcatgagccactctgcccggccatccatgtttcttttctttgatcttttcatgaagtcctgcccccgaccatgtgtttgtctgtttatgggaggttttgtttctgctgacctagaatgtgattagttgtctggtttaggaatgtccacatatttcctgatatggtatttctattagagacatttcctggaagcacacagactttgaggcagccgcggtggccttccttgttcttggcacatgcacttggagttgaagctgcctcagggtgcatttgctggttgatctgcaaggggagggagggcatgtgaatttggtgcatcatcacgttttcctttggaaacaagtgccatggaaattttcccaagaaagactgtgcagcattaggcaacattaagaattcaaagccggaatctttgctggtacactcggaagatcagagacaaagtgaatgggtctctctttggttggcttgctaccatgatagtgataaatgaagagctttgaatgggaaatttaatgagtccattgggaagtcttcaacgcagagagcgtcaaaatgtgacagatgaagagcagtggagtagttagccgggaaacctgctggaactggggagagagctgtccccaagagatagcgttccccaaaggagcaggtgcaattacaaacaccatggagggaaactaaggaattctcacagccatgcttcacagcttagaaggaaaggccaacttcctcatcatctccagaccaagagaggctgaggggtggtgaatatcagtgagcaactgtcctgtgtcagtcaggagaaaaacatgtttatcaaaatgggagatttgagtcagactttaagaagaattgccttgattatatggcattttagatcctggaatagttttccacagaaggtcacagaatagtttatcggagaacgtcaataaatccgcatttaaattgtgctgtgttttactgcatgttctcactcataggtgggaattgaacaatgagaacacatggacacagggcagggaacgtccacaccggggcctgtccgggggcggggggctaggggagggatagcattaggagaaatacctaatgtaaatgacaggttgatgggtgcagcaagccaacatagcacatgtatacctatgtaacaaacctacacgttgtgaacatgtaccttagaacttaaagtataataaagaaaaaaagaaaaaaaattgtgctgtgttttaatggttaggatggcagctcccttggtgaagtcttaggagcaggtagactggactcccaaagatgttcccagccctagggctctctggaatggcacatgtggccagcgattgccatggtcacaagctagcttagtgcacgggaccctgcaggccggtcctgccgtgcatgtactttcctgtcattctcttatgcactcgtttgtttacggattcaatcaactcttcttgaatacttcctgtgttctggatactgcctgatcccggatgcagaagaaggacatggtccctttcctcactagcttctgcttctgatggcacattcacctattggcacattcactcgctctccccaaccgcgaatgctgcccgttgccctgctctggcacggtcactctcataactgtccccgtctgttcacactgcccaagctttcctctcctgtccacagcaggggctgtcacactatgtatttgatattcttctcatttttcaccaagatccttagatcctcaagtcttaacaaagtgatgcccctgaaaacaaagccatccagacaggcctcatcgcctaaggggtcattccgtacttgcttgatacagggcccatgaggccaatccagctctgagaaaaacttctctccaggggcggggacatggccatggggtgtgctgtctggaggtccagctgtccttacctcctacacaggtgttccgggctacagccttgcagcatgctgtctggaggtccagctgtcctaaccatgtgacctcctacacaggtgttccgggctacagccttgcagcgtgctgtctggaggtccagctgcccttccccatgtgacctgctacacaggtgttccgggctgcggccatggggcgtgctgtctggaggtccagctgcccttccccatgtgacctgctacacaggtgttccgggctgcggccatggggcgtgctgtctggaggtccagctggccttccccatgtgacctgctacacaggtgttccggctacagccttacagcatgctgtctggaggtccagctgcccttccccatgtgacctgctacacaggtgttccaggctgcggccatggggtgtgctgtctggaggtccagctgcccttccccatgtgacctgctacacaggcgttccctgactgactcacacagacactgtacccacaccctgcaccggccccaccttagtgattgctacaccctctcaagcctgtggcagttgtggctctctaagccacacctcagtgtgaagcgggatttaaggaaccagagagaccggatggagtgcaggagggtgtttattttaaggtgtacacaggcccagtggacatgtgtcctaaaggctgagcccagaacaaagaaaacgagtcccttttaagcattttgaggcaggaactacgtgaagcaggcttacagaagcgagaactaaaggctgctgtgacacttttgcaacatggcttacatctctgtgagaacttggtttgcggcttgtgcttatctgtcttgtgaccttgcagttgtggggggaagaaagaaacaggagtttacagagcctacaaaatatgtggaggatagatatggttattgtttcttgggacagacagttaatatactcttctaacttttaacttcagcggggctgcttaaattctcctcagccttggttaatacagaatttcattctatgagctattgttatttttcttactattattataatttttactattactacttatgctattattctgttgttttcttaatttcccacttcaagtggacggagcccattccaagcaaactattccaaggatagctgtttttcttcttaatacgccaacagcgagagagcgtgagccttcctttacctacccatgagcatctgccagtgatccagcgggcactgcttcctcccagaaccgtgtcttgacacttttttctatgaatcagtgaaagattcaagaaaattggagttgaggggttttttttgcactcgtgctgacttaccttatggcattggggtttttgccttcaataaaaataattttttaaagtagcccattaaaattgtaaaaatccatgccttcaaaatgtcagtaattcaacctaagatatggaggaagagcttgcgcttgaaactccaaaacgctttgttagagggacgaaagggcagtttgatagcagatcggagggatggagggcctttgcttcacccatcgctcacgtgtgggcgtctgcacggggaggagcgcgtggggagaaccatcagatttcagtgtgacagggaggccacgtgggtggcactgcagcagcagcacagagccagcgtgagggcaggctgggtgcagccaggagccagctgggagtgggaacccagccaggcctgggatgtggaagcccccactgagaaactcccttgtagggtcccaggccacctcctcagcctcagaatgggaaggtcctaggtaagaggtgaagccggctgggcttctgggtggggtgcggacttggagaacttttctgtctagctaaaggattgtaaaggcaccaatcagagctctgtctagctaaaggtttgtaaacgcagggatcagcactctgtaaaaacacaccaatcagagctcctgtctagctaaacgtttgtaaacgcactgatcagcactctgtaaatacgcaccaatcagtgctctgtgtctagctaaaggtttgtaaacacaccaatcagcactctgtaaaaacggaccaatcagcactctgtaaaatggaccaatcagcaggatgggggcgggccaaataaggaaataaaagctggccaccgccgcccaacagctgcaacccgcagctcgggttcccttccacgtggaagctgtgttctttccttcttcacaataaatcttgctgctgctcgctctctgggttcgcactacgtgtatgagctgtaacactcactgcaaaggtctgcagcttcacttctgaagtcagtgagaccacaaacccacagggaagaacaaacaactctgggcgcgccacctttaagagctgtgacactcactgcgaaggtctacggcttcactcctgaagtcaccaagaccacgaacccactggaaggaagaaactccagacacatctgaacatctgaaggaagaaattccggacacagcatcttcaataaccctaacactcaccgcgagggtctgcggcttcattcctgaagtcagcgagaccaagaacccaccagaaggaaccaattccggagaaacttgttttaagcgtgagaaggaaaagaatattttattttgtttgttttgctcttaaagggtcattagtaacaaaagctttggagtcaaaagggccagattcagatcgtggttgcagcacttactagttgcgtgaccttgactgagagacttaatccctgagcttccatctcttagtctgttaactgaagtaacagtgcctaccttgtagggctcatggtggagagtaaaataatctactcgaagtacaggctgtggagccttgtgtaaataacgttctcaataaatgtctttgattgttgctgcttttactatttgggttaatcgtctgagaatgagaaggaaaataagcatttcatcagatggaagtctggtgtgtgtcagaaggagagttgggctgcccttgataaagcagagaaacgcaggatagagacagaagctagggttggtgtccagagggcttcatgacgggccagcccccttgtccatcaccatccacagtgtacctgtgtggactcacaccttgctcttctcccactcttagggagggagggggaatgttcagaaaacaacatcaatttctacctcctgaagtcgtcagccccttgtaactattcaggagcctgtggctttagaaaaggccattgtcaggtgacagcaattcccctacgctaatgccacgccagaaattatcccttgaatggagagagtatgtttcttataagaagctgggtgtcctgcttcctgtatccagtccaggaagcctgcatccggtccgcagttccccattaccacctgggcaaccaccagggagctgagcagaaatgggcccgtcgcctcctcctacaagttacagcctggctcagggttagcgctgcccacccagtcccatggctgtagcaaagggggcagggagcactttactgaagtggacaaatccagcgaggggaggaagattgatctttccagcaagaggagagtctttaatgaaatgtcctatatgtggagaagaccagactaaagtgacatcccattaataacttataaaagcctctaatcagcttgggttaatttggtattcattgtaaaaacattcatcatgggcactgaggtctgtgacagtagccaagaaattaatatcccacggatggaaatggccttctgtaccctcagataatggatggagacagtttggtgagtgatttgttagcactaccaaagggacccttcaaatgtaacacaatatgttatcacttcctggctctgtggggctaaatcactttaatattcacttgcactcaagtaaataagctgagtttttggtaattaataggaatggatggggtcgtatgacagagatacctgatggtcatggttaaagagtgaggagaattaggaaataattatggggccctttcctgccaccaagaggctcttctcctgggatacagggatttcagaaaggaaatgcgtaatcataggattatgggggaagtgagagaagaaaaatataagtaggacatcaggaggaggtggagatttgttttaactctgtgtaaatggaggaggcataagagaaaatttatttataaaacaatatgaaaatatgcagaaagagtcatcaagacattcctatacaagatcacagaaatccctctaaaaagaagcccaaagctatatcaacaaacacattcataacactgttatccataacaggaatttctaaaagctggaaatgtcctaagtgttgagagctgagccatttgctaaatcatggagtatccataggaagaggtattatataaccatttaagattatgattaggaagactgcatgggagcatggagcatatatcatctatcaaacaatagcaggactaaaaataagccatttggtatgttggcatatggaaaggattagaaagtaatatattagtcaaaataattatttggactggccagactgggcttttttcccccttctaaaactttcttggttaaagcaacattatatatatattttttttaaaaaaaaattaaaaagagaagaaaatgtattgttaaaaatgggatttaggaactctactcaataaacatgtgctcaagtagtgttgagggtaaagaagaggcgctttttgcagagaatccaaacatgaataagccgcccatcaccctccggggatcacagtgccgttaattccaccggtttgaaagctctgttgcaaacccttcagagatattttctgggactcactctctttttgaaggagagaaagcagaataacaaaattcaaggtcacagattatgagtgtttaatatctaaaaattatttttaattgataagtcatcatcgtatacacttacgggatacaagaggactatagtcaataataatgtgttgtatatttcacaataagagaatacatttcaaaaaaaaaatggtaagtgagccttgagactcactcttaagccagaacaaaattaaggaaaaggtggatgcagggttaaaaccgggcctgacctgcttgcccacgttggccggtgaagataaaccctattttcttcctcatagcttccttaattcaattgcgactgaaacagtgtatcatttcttaggaataatcaaatttagaagggtgcccccacatcagcctcggcaatattaggttagagaatttcaagatcatttatcaaatagaatttaaagcaggaccagagttgtacattaaggaagagtgcacttagtgatagattcttgagagaatataacaaggcagttagttataaatgaacataaccttttgagacctttggatgatggggcgtggagccgcaccacacttgcggccatggcagatcctgtttctcgtcctgtggagggagcagcttctgaacatttggaggcttttccggtcgcctcgggtagggcgggggagggctgtactcggtgctgccaagaattctccttcgtgcacctaatcgggttctgtagattactttgtggaattctcccgtttgggtggagggaacacctcttcatcataattcctaaatgtttcaccattggaaaatatcaaagtaaaggttccatctcctggtctttgtagaataactgcgaccttttcttcctttaaagtgctgaaatactgtcagtcccacttactgtagcagttaatcttatgcctctttgttttattattcaactattttgcttttgaataactttatttcccagaccaaatgtaagctgttgaagaacaaagaatgtttttcattagacttttgtcttccacagcccgttgctcagcattgtgcagagtgtaggttctcaacaaatacttgtgaaatgaatgccatccagaagggaaagtaaaattaaatgtcagatttatagacataaggtccaacattcatggaaattggaaaactttgacgttataacctaaaatttttgagatttaacaacttgtctgatggcaaattaattcagcagttcagattcagttcagattgtgagcaataccaaggaagaaaatctggattttcgagtcagacatttgtcttaaaatgtttgttatgctgtgaaagatcttaaaaggaagatagagagtgctcctgattaaaacctgtcaggatcaggctgaactcaacaaggcgaaaggacctgaacttcttgtctttccaaggacgtttcagaggatgaaagcgcctcacttcttgtcccactaggacaccgaggtgatcgtctccgcagtgtcataaggaacagtgaggcctcgtgggcttgtgcccctcacgcactctccggtttgaaattggggtcggccctcattctaatgccctgtgagggcctcagaggttattgtctgggttgttaaacgtggagacagagagggcacagaacagaagataatttgctcacttaaaacaagaggtttctaagaacgtttggagaaattttagtgtgtccaagtcagttatttgtgaatgattcttctggacctttctgcaaagtagacttcacagggctcctcctttgcagaattttgttagccctgattgattattagaggttaattatcaatactggatactaacgtacttctgccctttgacgtgggtatttgcacagcccacgaggttttatttcacttctctgatgtgtggggaacacagtgccttactcgtgctagagcagtgatagacgtgagcacagataatcaatgagtcaatttcaatgacagaccactttggtttttttttagactgtgggttttacttttgttcttttgtttcatttttttgttgttgttttgttttgttttttgtgtaatagctcacatctagttcagctatttccactctaaaaaaagttagcaaattagtgaattgatttttctgtttgttcttcagtttgaaaacctcttcatttatctgaatggttttagttttccctttaatggcttttatggccaggaactgtttgaaatatgttttaatttcctccattaggccagatttaattaacgtacactatgcatgttggtgagctgagtgtgccgtctgacctccagcctagatcgctctagagcctgcgcctgtcccgtgagtgtgaggccaactgtgcactccagactcagttcattcataaatctaaactcactattgtttctgccaaagctctgccctgtaagtggtaccaccatctcttctgtgccaggtcagccaaattcttgactccccttcctcccccaccggcttgatccactatacattttatgaattctgctttcttggtatcatgaaaatccaccttcttctttctgttcccaccatcacctcatgcctaggttcctgtaacagctgccttcttggtttttctaccccaaaactacccctactccagaatgttctccatctctcactgagtgatctaaaatgcaaatataatcatgtccattttcccatgtaaaatccttccactgttttccactgcctttaggatagaacccaaaccccttcacatgctttgtgaagcccacctgaggtgccatcactcccctgacctctcctgccacccagtactcccaggctggagaccagccataatgagctacatccagttccgcaaatgtcccagaccacctctcactgcgaagactttgtatttgctattcacaaagtccagaacacactctttttttaaaaaatgttttaaaagaccatgtctagctctatcacccaggctggaatacagtggtgtgagcatggctcactgcagcctcaacctccttggctcaagcgatcctcccacctcagcctcctgagtagctgggacctcaggcacgtgccaccatgcctgtttagttcttgtattttttgtagagatgggggtctcactgtgttgcccaagctggtctggaactcctgcactaagcaatccttctacctcaacctcccaaagtgctgggattacaggcatgagccactgtgcccagcccaggacacactcttaatcccccacccctcacccctaactccaatccctgaagattgggcttgagacccctctgctctgtcccctgccactctgccattgccttatcaccacactcatcactctctgcttttgtgacctgtttccttgttattctcccccagccaaatccaagctccttaggaacaagcacctctcgtgttcactgctgtgtcctcagccactttgtgtagactgttagtaagcattaaatacgtgttcaaaggttgaatgggtgactcagtcaattaaggcatattatttacccaagatgaaaatcaattacttttttcaatttaagcgtaaactcgatttatgaatttttatgaaatttgtttctgtgttttcacctattggagatgttggctgacctttcatctctagccacaccctgtggcatcctcctttaaattttagccttttcagccaccacatgggtcccaattaccatgacaccgtgttcaaacccaggctcaccagtttctagttacccttcagataaaaaggttatgattgcacgtacatgtatctatttaattaagctagttttctccatggccatacaaagtcgtgtttctaaaattagctgggtgatctgactgtttagtggaacttgagtctttagaaggtcctcagataccactgctgtctacttcctgtaaatctaatcatcacaggacaaggtgcaggataggcttgcttagggaatgctgccttttaaatttcctatgttactgcatgacaagattagttgactctgataactccctacaaaagactcagaataataaaggaataaattaatcagtcaatggaaaagcaaacgatctataccaggctgatgaactataatagaacatctcattgttacacagagtcagccgtctcccactgccctgctgaatcctatctgaacagtaaatctgtgttgtaacagagccagcatggcaagcagctgctcagctggcctttcccctcctgtctcataaagaaaaatgccaatgtattcgtaatttcccagtgaggtggcagagtctgtaaatccttttttccaataaccctaaaattttactagccaacggttcaacagcctggtacacatttagggaaacaaaaggtttatggtggcagatgattgtttagaataatgtttcttaactcagctacacttcaacttgtgtaactacgaatgctgtggctgcatgcccagaggctctggttcgtttggaccagggtggggcctgggcgtcagggtatttgaaagctccccaggggcttctgatgtacaaccatgtctgagcatcctgggtttagatgcttacaggcgggactgggactggatgacctctttaataaactttgaagtttcaaggtcaacattccaacttcataataaaatatagaatctcttagattatatttttaatcaccaggcccatcacaagggaggtgctgaatataaaattgctggtcattaaaacattgccagggaaattgttgcttcaaaaaggcagctgtacttccttagatcaacatgcatggcttggccacgttgtagtttactttgctcctggtcaattcaacttaattcaactcaaagttaagatcaggatgtgataaaattattttgttttctttttctttgaatcctggatgagaagtcattgtccaaatcattaggtgttttatgcaatattaccaatctttagtgtgattttccccccatcaaacctataaacaataaacttttctaaaagaaagcctgccatgatggaagcactgggtttcagacagcaagtctcactgcatggctgtgcaggttgggacatactaacttgtgataacagcggccttttagatagggctcacaatgttcccaccaccatgctaggcactcagtgtattactgtctcttttgctcacaatatctctattcagcagtgagaaaatagaaattcagaaaatggaagtaattttccccgggtcacatatcagggatggtgtcagaactgaaactgaagaagtcgtgtcccagcttcttcctttggaccgaactcttaagtctggactctgttcagaatgacttctctcaagaccaaatgttctcaagtctatgagaagcctttgaacacctcttaaatgcactgtaaatacagtgttattaccatgaacgtgatatttgtatatttgtattcaaggccaccataaggatttttttttttttggcaatgcacagaagctggatgtctcccgatacagcatctggtgtaattaatccgacacccttatctctccccactgagcattctcaaagggaatgaaacattgacctaactgatatttccctctaaaatctttgcaggttccataaatgagctgtcagagccccagggcagacactgaaccccaactggaataaaacgttcctcctggagagggtgggtcagttatccagcacagcattcctcacatcccaggggtgtgcagagccctttcagagctggatcaaacaaatgaagcttgtatgtctccttttccagggggtgacctaagtatttgatgttagttttctacgcttcattattttttttatttcggatgcattttaaatgttaatgaaatattttatgaataaagagtaataaaatgagcactcacatgccctccagtcagcatgaaatacagagcattcccaagcatgcccagagctcggactccaggtccaccgggttccgggtccctcctccaccagaccaaccactcctctgaattttctttatgtttccctgccatttatggatctctaaacaatataccatttacattttgaacattatgtaactgttaccagacagtatctatactcatgtgacttgaggttacatcaacatagtatagatactgtctgtcttgtcactatacagtaacatgagtgtagacgcttgatgtaccctgagtgtacatactgtctggtaacagttacatcaagttatataaagtctcctatattatcttgtatgaacatgtggaagcattagctgtaattgagtctttttcagttttctgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaatatgtggtatagttcccagtttatttacttaaaaaatactttctccataaatttttataattttctccaaaacagcttgcaaagctggtttaaatttactcttacatatcttctttggatatttttggtacatgtttcattttgtaaatgtaatttttagaatttatgtctgctagtgtattagtcagggttcagactaattagttagagggacagaactaacaggatatatatattaacttacacgatcacaaggtcccataataggctgcaagctgaggggcaagcagagccagtcccagtctcaaaactgaacaacttggagtctgatgttggagggcaggaagaggccagcactggagaaagatgtaagcttggaggtttggcccatctctctttttcatgtttttctgcctttttcatattctctggaagctgattagattgtgcccacccgattaagggtgcatctgccttccccagcccactgactcaaatgttaatctcttttggcaacacccacacagacacacccaagattaatactttgtatccctcaatccaatcaagttgacactcagtattaaccatcacagctggttaatagaattgcacttgacattttctattgattttgcatccagcagccttgctaaactcatttacttccaataattgatctgtggtttcttttggatcttgtatttagataattacaccctctccaaataatgacacatttatttcttcctttttcatcctcaactctgccttatttcctgatcttactccactctccagaaccacccacactatgttgagcagaacagcaatagtgaagatgcaaccctcgccttctagctcatcatagaggaaatgctcccaagtttttgccatggaatgtgaagttgctgtagattcatttgggaatgaccttggtcagtttcaggaaggccatttctatttctagtttgcacgatttatttgggaatgacctcggtcattgggttttgtttctttggttggttgttgttgttggtcttgtggtctgtgttctgtttgtctttattttgaatggattttgaattctatgaagtatgttttctgaatctattgaaatgatcatgtgggttttttttcctttaatctgtcagtgaggtgtattgtattgtcagtagaaaaccagccttatgtgactaggatagatgtgattgattgggatgtactttttaatatatacctagctagatttttttaacatattttctttaggatttttgcgtctgtgttcatgggtgaaattcgtctacactgtgggacattattgaatttaaaatcagtttattagaatggtaggtacttaagtaggtacaaacacaaaactatgcaactataaagccatatataatttaccaattcacttcaacaaatctacgaaagcaggaaatttaaaaacaattatatcaatttgcagtgctgatgttttactgaaagtctctggcagctggaatatgatgacaatgctgactgctccatgaattttcctttcttctcctgcattaccacgtgacttgtcatgacttaatttcccatgcattttctttatttgacctatagagaaaccttctttggaacaatacagccatgttattgttgctttgcttggcaggaatacatctttcgcatgtcaagtcccttttattcttttctcactggcccacaataactaaagcagtactacttggcaccagtgtgcttataaacataaattcaggccctaaaatcaggatagaaggacttgcttattggatagtcatccaggtggtccacaatatgggatatacattttactaagattctcatcaaaatgaacatatgaaatgtcagtgttttataaggacctgtgtcctcagattcccaggttgttatcactcagtttgagaagcatcccatccagagtttttacagaaggaattgttagtacagtttgctaggctgcatttgaaccaatgtcggccttcccttaggaccagcagagacggtaagcagaacttaggtgagtggtaaggagtcttttagagaagtcctcctccctcgagggcctcactcaagatctgactttgtagaaagcagaacttcacactgactttgagtaactgtcttccatgatgagctggggagagaatggaacggtgcccatgagactgtaggacttcatgaccttcagctgtttctccacacagagtgctctcagcctacagcgagagaggaatgatcccaccagctggaaatagagaggactgcaacccaaaccaccccccaccccgcatcatgaggcagcaagagttggacatatcttctccccatcttcccctggacacaccctacagaaagtcctgtggaaacaccccactatgaggctgccttattctcatgttagcctgatttgcaatagggaaaatgttgaggacacaaaaaaccctggctttatttgccctgatcacttcatcctcatggtggtaaaaatgccccatccatgcaacaagtcttcaagcacctctcatgtgccaagcagcccctgccttaggaccacccgctgttaagtgttcactggtgatgccactgtcttaccttatgagcactaaatgcttaagcagggctggtaaaacatagaacatttctcaggttattgtttcaaaatacactgtggttgtcaggcggaaaaggtttccctcttaggatcacctgtgacgagcaacgtcaaagtgttttggtgcaactcaaatgctttgctggaactgtttttctccatacaatgtacggggaaggcttccatgtcatggaacaaagtggtgaatgttcaaatggtcagggtgtgatttcatgggctgcatggattaaggaacattgaaacataaagttgaggacattgctctgttttcaattctctcaaacttctgttttccgatgaggagcatgattttgacacctcctaattcttgctcatgtctctttttaacaaatggagagtgagcctcaggcccagaactccaagcaggactgggcagaattcattatcatgttttggttttttggtatttattttatgcttatcattacttcactgcaaagaatactggtgttccatttatagtagtaatacaaaatgtccctgataaatgaaacttgtttacataaagagggaattgactgaaaagaaaataaagcagccgggcgcggtggctcactcctgtaatctcagcactttttgggaagccgaggcgggtggatcaggagttcaggagatcgagactatcctggataacatggtgaaaccccgtctctactaaaaatacaaaaaattagccaggcatggtggtgcacacctgtagtcccagctactcaggaagctgaggcaggagaatcgcttgtgcccgggaggtggaggtggcggtgagccaagacggtgccactgcactccagcctgggtgacagagtgagactctgtctcaaaaaaacaaataaataaataaatgaaagaaaaaaaggaaaagaaaagaaagcaaataatagtatcagaggtactcacaaaggtggttagtgtttaaccagccttgggaagtgctcctgtcagggaaggaagccagggtttagcaacaacacacgttgggtggaaacccagccctcactggattgatgatgtgtataacccctctgagcctcagtttccccattcatgaatagggcaaaaagacctcccagggatgctgtgaaggttaaaggcaataacttataggcagcattccttatgtggtaaatgttagttccctccctgatgttggaggagaaatctattattatcttgaatctgggccaaagacataataatatttgcataagtgatgaaagatgacaaaatggaaaaacatggacttgtagcaagacaagcctattagctttttcgaccttgaaacttctgatttgatttcctaatccataaaatgaggaagattaagatacttattttgcataattattgggcaaatctgaggtaatgtatgtaattaagtcacgtcctagtgatcacatcaagtacagagtaggcctcaatcaataacagctgtttgttatggtcctcactggggaaggaccatgactttccttcctcatgtgagaacctcctttatctttcaaattgtatcctcatgtgcataaaatattcttcagagtttgtagggaaatcgtttgattaatgttggggtcaagaagcaacaaggtgttgcggggacatcctctagagccttgagaatttggggtgtgaaattctaatttctgagatgctgatgtagctacagattctacatagagacccactcacctcattaattcaaggttcagggcactgaaagcgcatctacccatcatccttttctctttttcatacttttatttgaaaactattattctctctctcttttttttttttttttttgagacagggtctcactctgtcatccaggctggagtgcagtggcacagtcatagctcactgtagcctcaaactcctgacctcaacctcaagcaggtgttcctcccatctcagcctccctagtcactgggactaccggcacacaccactacacccggctaatttttaaattgtctgtagagatgaggttttgctatgttgcccaggcttgtctcaaactcctgggctcaagtaatcctcctgcctcagcctcccaaagtgctgggattacaggtgtgagccactgggcctggccctctttatttttctactgacaattaaccttctacttgaccagaggtctttttaaggattaaagagtggtaatttggctcccctaaaattcacagctgtgagtgtgctgtgagttgtgtgacagctgcattgcagttgcaattgtgtgctagtttctaacaaggggaagcaaacgctgacgtggccgagaaggaaggcccttactatgaggcttccgttaagtctcctccaggtcacattttcataacaccaagtgatatttttcagcttgaatgtctcctgatattataaggagtttgaaattttcctttattaattaacattttcattttgctcacattttggagagcactgattttccagaagtgctaattaccaagctcacagcagaaggttggctgcattttaaactatttcctcagatgctccctgctgaactcagagatgtcctcattcagccgagccagcctcccaggtgggtgggaggcccctggctggtgccactcacagactttgggcttcttctgaacccgcggagccctgaaacaccaataggcccacactcctgagggggttctggccacatctgcctttaggaaagatctgttcattggtgtaaaaccctgacgtgtgacatcagaaaaccagagcacctggccatgccccaaccctgtagctccaggcagacctccctatgatgtggcctgccatagtcatgtggctcgtgatgagtctagaaggcctggaagtttctgtctaagtctgggcaaaaacagagggactcacagcaccccttgtggtgtgagagtaatagatgcatgcatacatgtgtgaaggcttgtttgcagatgtctccatctgttatgtctgagcccattcaggctgctctaacaatatcgtagactggggtgcttagaaaaaacaaattgatttttcatcgtcctggaggctggaagtcaaggttaacttgctagctgattctgtgcctggtgagggcctgtgtcctggctcatagactgccttcttctgtgtcctcgcttggtggaagggacaagggacccctctgtgttgtcttttgtaagggcactaatctcattcgtgagcgttctcccctcatgacgtgatcatttcccaaagacctcacttcctaataccatcccattgggggtgggatttcaacattggaacttggggaggacacgaacattcaatgtgtaacaccataaagaagacatgggaggccaggctcagtggctcacaactgtaatcccagcactttgggaggccgaggtgggtggatcgcttgaggtcaggagttcaagaccagcctggccaacatggggaaaccccgtctccactaaaaatacaaaaattagccaggcatggtggcgggtgcctgtaatcccagctactgggaaggctgaggcaggagaatcgcttgaacccgggaggcagaggttgcagtgagctgagatcacgtcactgcactccagcctgggcaacaagagtgagactccatctcaaaaaaaaaaccagaaggcataggaatctggtatgtatgtactaatcttcaacattgacggtccccagcctttcaatccttgatgtaagtgatgaagatgagcttctgatctctcaaggcccggcggacccctttcctaaacctggggttaccattttcccatgcctgggggttttcccaggacattcatgctgataccaggacagtcccgggtaagcgggatggttgctcatgctgttgacaaggctctggggatcttggcgccaccaccttctcctcgtgccacacacacacatgcacacacaccacccatgccagacttctgaatctcatcttatgagtccattaattcactgttccccacctgctatatgtgcccaaagatttgagatttgcatagacaacattttgaaaagttttatcctctgttttgtcattaaaatagaccccgtgggtgggtcagcaagtgatattaggaagacgggggtgagatggtatcaaatgaagggaagactacagggctggcggcaaggacacagatttggggtagcagccagacttgggaatttggtgagggtgcatgacgcccaagactattgcagagcctgatgcctcggcccccgggtacctggaccacagtggcagggcgccagaaagggctgtgagggaactaggtcagcaaccaaaaactcacaggagtcaaacgaatactatgagccactatgtttgcccagagctgtgctagtgtgtgtatgagatttttaaaaagggaaaacgttactgttgcctgaaggagattaatatgtggataagacatacatacatgacagaaactaagaaagttattacaagattttaaccagagtcttaccaccctatttttaaggcaggagaattgtatgaaatgattgctatagttcagagaggtgaagtaatcctctaaatcacatagtgatttggtgttttgtgagtttggagaaggagaggtgaaggtggttctggaaggcttcctccaggagatggggcagactcgggctctgcagagcaggcaaggtcatcagagaagcggagcagcagagacctggaggcaggctgtgaggtggctggcgctgtgtggatcagggaggtgccgagggtaggagaatgctggcctggttctaagtcattggccctgcggcacgtggcctgtctggaaatgagttcctgcagacactctggacaggcaggagacctcaatgggcactggggcaacctgggccagctgtaggcttccttcctgatcaaacaagcggaccgtgctgagacacctccccgaaagccacaggtctcagccccttcatgggtgaccctgtgttatccacctgagaaagggcccaaaagaggcctctcagaggaggcaggccctgtggcagcacgggccttgaaatcggcccccggggcccctgtggcttcagtccagggactccatgccgggcgctgaaccacctccacaaaactcatgcgatcctcagagccccgcctcatcagccggaggacaggggtcacctgacagtgtgtctgaatgagcggaagcttccgttctgtgagagctctgggcttttgtgaactgacacggggcacagccacccgggcccctgggtgtggagtaacctaagaagtcgtgtacccctggggtgatgaggattgaggctaagatgggcagagggagaggaaaggttacacgggacccagtgacaggagtcgcagtgagttcagccctggtctgcccagagcagtccaagtttacccgggagtccaggggaagtcacaaatagagcttcctttcatgtgcaaatgtcccctcatttggatgataggttataggaccctcctaagtttggtgacttctgaggtctcaggctaagacatttctttgaccccactacagatgaagtacattgtttaagtgttggagggagtggcctagcccagggcccagagctggagcctgccagcctggtccccatccaggcccttccactcatgggctctgtcctgttgggcaaatcacctaggctgtctgtgcctcattttcctctaatatggatatcaacatagcgcccacctcatgggcttatgaggatgtgactcatactatgcgtgatgccgtgttagcctttgttaatgagaacctcctggtcagagctgtgctgtgggcagccaaaggccgattatggagaaccacccagagtggagttaggagccggcctcggggggccggtcacagagtggctcagctggtcagaaatcatgtctaagtctcacacaggcaggaaaatgcgacagtgagaaagggtcctgtcccagcccctgagagagtacgattctacaaagaccctgacacctgctcttgtgactgagttgcataaagtaggggttgaattcctgagtccactaaagacatgtacttccagaatggtaggagtgaaagaggggtgaacatagatggagaaccaagggttttcccaggtgctgtttgtaggtcacacaggggcacagtattgatgggaaagtcagcctcaggcatcatgtgcatcattcaaggtgtcccgtcatgttcctggcagagttggcttcatatccaacttgcctgactccacagcagcctccctttaaggaggcttggacaacccaggccgccatgaccggaaccccagaacctgcccacgagaagttgctcctgttctcctcctcccctgcgaggctcctctcaggccagggcttccaagtcccatgtaggcctccagagccaagacccctgcagcaccctgtgcactcaggcagaggaaagagcccaggatcctgcacagccccttggctctgctgtggcctctcatcgggccccttggcattccaggtggccctgccatcccacagacatcctccaggaagccaaggatgggaaggattctgaggtctgtttggcagaggtcacatggatacgttatgggagaggagtggtgttctggcaccccatggcttgaaggtttccattgttttctctgttgatataaagactggttttcagacagaggcaataagggaagaaacaataagtgagaaggtgaaagaggtcagtgttagacgtaaaaatgccacttcttctgcaaggttttcttgaactcccaggttcgaattcccaccaccttcagccatggcgtgcgcggctctgtctgtacactcagtgtacagtaaacatttgtctacaggtctttcccgtaacttgtgatatcccacacagcttaggatggtggcatatttattattttatcaccaattcccagtacaggtgctaggttcattttaggcatttggttgaactttatcatttatttattttcccattataaaaataatacagaatatagtaaaaaataggaaaaaaagcctttttaaaatagcatcaatagacccagtatctaaaattactattaatattttagtatgttttctaaatctatttccaagaatagatgtatttttttagttacaattattagttttacatcccaaccttttgatacaattagcattgtatacaattaaatacttattgttaacataattttcatagttacatagtatttcattgagtcgatctaccaaaatgcaattaaccattttccagctagaccagctggaccatgtataatattccctgttatcactgatgctgtgaagcacctttgggtctaagatgttccttgagtggaattactgagtcaaaaactaggaacacttttttatatacacttttgatgtatatttgcgaattgtcgtccgtatgcctcatcattcatcctgattccatgctcaccagcatcaggtgaatatgcaattcgttttaaagagaacttgctaaggctatgattttttaaaaagatctctgctaatataatttaattgcatagctatttaaatcagcatatatttaattatattctatagttaattaaattcacatatatttaatagtaaattgattttctgtaaagtaataccagtgatatctttcttgtgattttattcttgctccatttatcttttaatgtcttggtgtgtaaataaccaaaaagctccctgaaggggaaagacagcggaaatcggaaatcacctctgagtccttcacggtccagccaggagctagtctcaggcgtagcggagcccctgatgcccatgccagaggcagcgacttctgagctgggttctgtgattcccctgctcatcctctaggaggcactaatgagcagcagtgagctgaggaagacgaagagccagaggactccaaaacctggaagatctgagtaacctacagacgggataacgagcccctgtaggctgcagagaggttggctgctggtcacaccaccctggagaagagcacggttccaagatcagccacccagggaacctgggagggaagcagacactgtctgagaagggaggggattgatgacttcactgaaccctgaaactgatctcatctgctccaaatacctgggatgatccgggagacttagccaggaacatctgaatgatgtttcatgggtagcattttactcttgctagaagccggaggccactcgtattaggactgtatacaaaaaggcccagaaacttaacaagaaaaaaatagattttttcatcaccttagaaagatattgaaaattcattcacttctttgcagtcagagggtgacttctggcagctgacaagtctcggatctaactgcaatataaaaagatttgtggagtgagagagtgcctcccactgctttctaccagtcaataaatttgtcagtcctctgaaagctttcagagagaaaacgttcacaatatttgtgttttggttcagacctgctcctataaaggccccgtggcccagccttgttactttcagctgcaagaggcagcagctgagcccagtgcaggggctctgagtcacctggggaacttgccgcccccagacagccgggcccctgtgcagagtgtgtgactcagtatgtctggggtggggcctgagagtctgcatttctaacgaatccccaggtgctgctgagtggctgggcccagagtggccttggagaagccctggcatgattgcttgtgccatcaggctgcctagttctgccccttatgggcagggcgaccttgggtcagggctggcttctccaagcctgcatctcagttccataaagtcagaacagcaccttcctttcctaggtgttctgacgaggggagtcttcagagtgtgggctctggagtcggacagcctgggtccaaaccctggctcctcacctgaaaagggtgtcctcttgggccagtgggctccttcagcaccctaggtaacatagccctgaaatgaaaatcataatccataataatgcctatttcatagaattataatggggattaagtaaattaatattttaaagtcttcagtgtttggttaataacaagtactatgtgaatgtaaaataaaataaatatgtgcaacacatccatcaatgcatggcaccattacgagccctcaacaaagagtggttactatttttggattcattggtacatggttccattaatcaataaatatttagcgtcaagtttctacaaggttctggtgtaggcattgaaagaagcacaagatctggtttcccttgtcttaaagattataattttgtgggcagacaacataaaacagagttcagtaacaggagtttctggagagtgctaccagcacggttcacagagcagtgggccagtatcattttttgggagagatcctcaggcagtggagtgacaggagaaggtttcagaatgttcagactcaagttgggcctggagcattttaggctgaaaggactgagaagaatgatgcttcagggagtttgctgctgttgcacgtgattttcttgggctggttcagccttcttcaaaggccatgttccaaaatcagcttcagttctttaagtaaattctcaatgagatcgtttttgcatgagcatcaaaaactgttgacctagcgaagaaaatgtgcatctacttccccaggatagggcggtggcccctcgaaccccatcacacacacagacctcatctgtccaggtaaatgagattctcaatgagatcatttttgcatgagcatcaaaagctgttgacctagcgaagaaaatgtgcatctacttccccaggatagggcggtggcccctcgaaccccatcacacacacagacctcatctgtccaggtaaatgagatgcccagagaccttcccatcagacagaccacagtccagcccttgcccaagggctcagatatgacagcaaacacttaaccctccacccttgccatcaccatcactcatccccatcaccccccatctgcctggatttgtctccactcaccaaaatagcccagagatacggcaggctttttggaggatctggttgacccatttcctatgatcctccaggatcctcctggagttcccaggtgaaggtcaggccgcaagaattaacctgcactctagagtcgaggaaccagccagagctcttccagtcttcctgtcccgctttgcacgctcaccacagactgggctttccaggcctttctcctctgcctctcatcaacagcccccttgtgctgataaccacgcaggctgtggtccagtgctgtgcccaggtttggtcagctttgtttagatctaagcctataccttttttaaagtataacccaacgctacctagtttaatttgtccaaaatgccaagtgatttctccacgtgttttgattttgaaagctgaacatccttatccataggcattttaatttggagagttggagagtgtcatgagctttgtcatttgctagggtgagggtgatccaggctgagccgccaggctgagtgcactgtgaattagcgtggtgtgcggggagttactggagtagtccctgactgccatatcattgcttcactcaccagatcatgcatcttcccatcattgcttctgttgatttatcctcatttctatggctgccacctgtgaaaggttcataaatctccagactgcatcgggctctaccttcattgggccagaaaaaaattcaaacccacaaagttattccttggaaaatgtagaggtgagatctcctccagaaacaagcatgctgatagttgaatgtggcacatgagatgtcactcactatccatctgccatcaccttatacaaatgcaggcacgtctcatctcattgcacttcactgtattctgctttgcacatattgggttttttacaaattgaaggtttgtagcaaccctgctttgagcaggtctgttgggaccatttttccatcacatgttcactttgcatctctgtcacattttggcaattctcacaatattttgaactttttcattaccattatatctgttatggttatctgggattagtgatctttgatgttactgatgtaattgttttgggagccactaactgtgcctatataaggtggcaaacgtaataaacattgtgtgttctgactgctccacaaacaggccatttccctcacctcctcttgggcctccctattccttgacacacaatattgaattaggccaataatatcttataaaatggcctgtaagtgttcataaatggaagaattgcaggtctctcactttaaatcaaaagctagaaatgagtaagcttaatgaggaaggcatgtcaaaagcaccacgataggctgaaagccaggcctcttgtgccaaatagttagccaaattgtgaaggcaaaggaaaagtctttgaagaaaattaaaattgctgctccagtgaacatgtgaatgataggtaagggaaacagcctggttgctgatatggagaaaggtttcatgctctggataaaagatcaaaccagatacagtattccctgaagccaaagcctaatccagaacaagatcctaactctcttcaattctgtgaaggccaagggaggtaacgaggctatagaagaaaagttggaagctaacagagggtggttcatgaggcttaaggaaagaagtcgtctccataacataaaagtgcaaggtgaagcagcaagtgctgatggagaagctgcagtaagttattcagaagatccagctaagatcattgatgaagatggctacaccaaacaacagatttttagtgaagacaaaacagccttcttctggaagatgatgccatctaggactttcatagctagagaggaaaattcaatgcctggctttaaagcttcaaaggacaggctgactctcttcttaggggttgaagtagctggtgactttaagtcggagccagtgctcatttaccattctgaaaatcctagggcccttaagagtgatgttaagtctactccgcctatgctctgtaaatgcaataacaaggcctggattatagcacaactgtttataccattgtgtaatgaatattttaatcccactgttgagacctactgctcagaaagaaagatttcctttaagatattactgttcaatcccagtatgcctggtcacccaaggactctgaaggagatgcacaaggagataaatgttgtttctatgcctgcccacataacatccattttgcagcacatgaatcatggagtcatttagactttcaaatcttataatttaagaaatacatttcatggctggcatggcggctcatgcctgtaatcccagcactttgggaggccgaggcaggcagattacctggggtcaggagttcgagaccagcctggccaacatggcaaaaccccatctctactaaaaatacaaaaattagccaggcatgatggtgggtgcctgtaatcttagctactagggaggctgaggcaggagaatcacttgaacccaggaggcagagattgcattgagccaagatcatgccatggcactccagcctgagcaacagtgagacactctgtctcaaaaaaaaaaaaaaaaagaaaagaaatacatttcataggctgggcatggtggctcacgcctgtacttgcagcactttagaaggccaaagcgggcagatcatgaggtcaggaatcgacaccatcctggctaacaccgtgaaaccccgtctctactaaaaaatacaaaaaattagcagggcgtggtggtgggagcctgtagtcccacctactcagggggctgaggcaggagaatggcatgaacctgggaggcggagcttgcagtgagccaagatcgcgccactgcgctccagcctgggtgacagagcgagactctgtctcaaaaaaaaaaaaaagaaaaatacgtttcataaagctatagctgccatagatagtgattcctctgatggatctgggcaaagtacattgaaagccttctggaaaggatttatcatcccagatgccattaagaacattcatatgcattagaggaggccaaaatatcaacattaccaggagtttaaatgaagttgattctaaccctcataatctttgagagattcaagacttcagtggggaaagtcactgcagatgtgataaaaacagcaagataactagaattagaagtagagcctgaagatgtgactgagttgctacagtctcaggataaaacttgaatgggtgagaagttgcttctaggaacgagcaaagaaagtgtttcttgagatgaaatatactcctggtgaagatgctaagaatattgtggaaatgacaacagaggatttagaatattccataaacatagttgagaaagaagcagcagggtttgaaaggactgacttcaattttgaaggaaattctgatgtgggtaaaatgcaatcaaataggattgggtgctacaggaaagcttttgtgaaaggaagaatcaatcaatgtgcaaacttcattattgtcttattttaagaaattaccagttatcccaaccttcagcaaccagcccctgatcagtcagcagccatcaacatcaaggcaacaccacctgccagcaaaaagacgatgactcaccgaaggcttagatgattgttagcattttttagcaacaaaacatttttaataactcacatacatttttagacataatacttttgcacagttactaatctacagcagagtataaacataacttttatatgcagttggaaaccaaaagatttctgtgactccctttattgtgatattcactttattgtggtggttggtggtctgggactgaacctgccaaatctttgtggcatgcctgtatatggctttctgtttttatctttgagatagagtcttgctatattgtcgaggctgggtctcaaactcctcaagcaattattgtgcctcagcctccagagtagctgagattacaagcacacgccattgatgtgtatgtgtttaagcatggatgaaccagacaaggagctcctccagggcaaagaccatcattattcagaaacctggtacaaggaaaagctcagggagaggagagggggagaagggagggcatagaaaatattgtaactgtagccaaagaagtggatatatttgtcaggattttttagtgataaaagacaaaatgtcaagttaaactagactaaacaaaaaggggaatgtcttacttacctgggatgatcagaagtgggtttggcatccagggactcagacagcatcctggggcatgtctctgcctccatccttatctcctgctattttcctttcctgctttcccttttctgtagtctctcttcagctctacttctttctgcgtgttcatctcgctctcttccagtgcaaaacgtcttccatatggccaggaagacaaatcacccctgggaccctgaggtctgtatcattccagtgccaggacccagaggcaagaagcagtagactctgaagctccaggaaaggcatgagaatacctgacccacccagggtgtgtcagaggccatcactcagggcccatggctggggtggcagggatggaatcctgcagatttacatgcctgagtggtatgcccattgtgggggccagggctcccagacagcccctgagtcacaggcataggggagagatggcctcaaactaggcaaacaaaaagtggaggtcaccactacagcagttagccagaacatgtgaaagtaaaacataggcaaatactatcttaagtcattaatccagtgaatatgatcttctatttgttggtagaatagagcaactgtagctgagctagtgattacagcaacatctgatcaatgctttcaactcagacaaagtggccagtttcctgcgtagaagggttggaaggcctgtgaaggccactgttgttccccatctggcccatcctgcagatgtcccccctctactcggcccctatgcagcaatgagggcggtcatggaaaacaaaattctcaccttctcccttgtttggaatgtcctggaaccatgatgacaaccagcgcccttcagtgactcccattgttctcacacaaaagcatggagtcaggagtgtaacttctaggatcctgcgtcccctgccacttctccagcttatcctctcaccgcctgccttggcccagctgctgtggcctcctcccttcctcggaggattgtcctttcttgccttgcccagggcctcggtgaacgtggctccctctcctgcgatgctctcattccccttctttccctgggtagcctctgctcacccgtagatctcagctcagatatgattctcagggcagacctcacaaccacccagacaagaccctcagggtgccctgttggcactttttaaacttcctcccagcaattcccagactggagaatgtcaggatgcctggccaggccactcctagtcagcccctggaggctcagtgactccctgtgaggagggggagtttatgaaatgcacagccttgggcagggcctgatgctggttcctgtcactgttgtgcccacctctccatgtccctggactcattagaagggtgccatctcttcagtcagctaggaacttctggagctcctctgttacactaaatagcttcaagtggacactgaacacgtactatcaaatgcttaaaagcacaattttattttgagaactttttctcagctttggaaaaataatacctcagaattctccaggttaaaatgtgggttcaggaggtgagaaagatcccaagagatttctctgggtgggtgactctgaaaaggaaggttttcctttagcgtttgaaagctgcattgatgggaaggtctttagagtggtgttggggcttttcatcttgattttggttgatgttttgaaagaaggaatgatatgagtactttctggtaggaagagcaattttagattatctacaagcatttctctttcttggcactacactctgccctttggcattaaatcctgaagtaatttgctggagtggaaaatgatgtaatacattatactggtttttgaaggaaagggcagaggggaaaagtggtaaagtgagggaactacaagaatcctgtgattaaaatgcggtcctctgtggtaaggattggataggttgatgacacttattatgctaataatatgttacctttgaaagtgttttataacctccaggattttctcccataaattatctgctttcatcctccccacagcaccatgaggcaagcacggcaggtgtaattatctgtattttgtggataagaaaatcaaaatgcagagcagttaaatgattttttttgccatatcctagagctgcctaggcaagaaccaatgaaagaaccaagcattctggattttaggctgatgggttaatcatcagcctaaaatatgaaatactcactcagaataaacagttatagccattgcaaaaatgagatgagcccttgcatgccaactgctcagcacctcgccaggtccatcggacatgccccgagggtgtttgtggtgttgatgatgatgatgctgaactaaatgagaatcatcaggaatcttaaacctctcattgatcaacagctttgacatctcctctgtattagtctgttaccacgctgctaataaagagatacctgagactgggtaatttataaaggaaaaaaggtttgattgactcacagttcctcgtggctgaggagacctcacaatcatggcagaaggtaaaggagaaatgaaagcacgtcctacatagcagcagacaggagagaatgagacccgagcaaaaagggagaccccttataaaaccatcagatctcccaacatgtgggaattatgggaactacaattcaagatgagatttgggtagggacacagccaaaccatgtcatcctctatccatccgttacaagccagtataacaaaaggttgtgtatttgcccagctgagcagtgaaaagggaaaaggccaaaatatagggaatgtgagggcaaaatagagtcagtatttagtaactcacagattgaatgttgtgttcctgaaatagagcattgggtactctgagaatgactcctggcaattttaggactacttccatgggaaaaagcacataaccacgtgtatacatacatatgttattaaccttttagctcaaaggtaactgggctttccactaccatcagtttctgtatacaaggcttgaaggccaattatactttatttccagcagtctcttcatgtaatctctgcaagaaaagtctcttttgataggatttgccgactttttcttcagtgttcacctatgctcccgtcaggtgagcacactgcattcttagcagtgctgggtgtcattagtgttcagtctttcataatctgataaacaaaacattgtaataagatttctttttgttattttttagcaatttgtacagttctttgatcgatctgtttgtgtccttcatacacatatttatagctcagtgatcatgattcatgctttccacttgtcggaatttatcccagggaaatatcagagacacaggtgaaaatttttgtgccaagatgcacacaatagtattttattacgataaaaaaaccaaaagactgtatgtcaaataataagggattaattaaataaactgtcatatctcttcaagggcatgtctcaaagaatgtttaataacatggaaaagcatccaggtgtggtggctcatgcctgtaatcccagcactttaggaggcagagacagacggaatacctgaggtcaggagttcgagaccagcctggccaccatggtgaaaccctgtctctactaaaaatacaaaaatcagctgggcatggtggcacatgtctgtaatcccagctactcaggaggctgaggcaagagaattgcttgagcccaggagacagaggttgcagtgagccaagatcatgccactgcagtccagcctcaccgacagagcaagactctgtctcaaaaaataaataaaaataaaataacgttgaaaagcattcctaatataaattaaccattatattatatggccttagttttattaaaaaccagatttatacctctcctaccaacacacatacatcttgaaggaaatgaaatacaacaaagttgatttgtgtatgttttgtagagacaggatctcactctgtggtccaggcaggagttcactgcagtcttgacctgctggactcaagcaatcctcctgcttctgtgtctcaagtagctaggactacaggcgtgtgctatgacactcagctaattttttaatgttttgttgttgttgttgttgttgttgtcgttgctatttgtttttgtagagatggagtcttaccgtgttgcacaggctggtctcaaactcctggcctcaagtaatcctcccaccttggcctcccaaagtgctaggattacaggcaggagccaccatgctcagctcgaagtttattttaaggtggtattttgtatatgtgtgagtgtgatctgtaagacaacgacatttttcttttttttttttttcaaatattccacaaaaaacaaatacttgtagtcacagtttggtggcttttgctgtgctgttttccagcttgtaactggccagactgattctatgatctcaagccagcggttcacttttcaaaaaaacccaacactcctttacccagccccatctttgttgttggtatatctctctcgcttcttcttattactttgtagtaattttacttcagaaaagactcagaattcccaccatcatccagtttctgacatgaacccatggaaggcatactgttcaggaaggttggcctatgtcaggggcctgacacctgctttgaagcacccatcaggggccatgtgtggaccaagcatacattccggctctgcctgagtccacattcagcatcacctggactcagtaggatctggggcagcaacggtcagccagcagggtgacgtcacacatgtgcacctctcctgcagtattcaatgctgctgtccccccaaccacacaggagctgccttctcccccagcactgctgccagatgacagcttggtgcagggagcaggacatccacaagtgggtgtggaatcttccctgcccgatgcctctcaggagccaggggcatggcttcagggccccaccaggaatgtgcacgagggtcaccagactgggagaagtggcagctgtaactccctcccagtactcatggttctccttatctcaatgcaacttatcataaataatgctgtcatgaatagaggtaatattcaacccttatcaggtttccagggcaacaaaagcaggaagtcagctgatggtcaaattcgctgcaaagaggactcaccttaggttctgagtgccagagtgtttcttcaatctttcagacacagctggtaatcctaacttgctgttatatggcctattgatgaaaccactcgggaccacatgtggcatttgtagcacacccagaaattaaacccatgcagagaaacgagctcaccaggactccttaggttgtccttggagggcttcctcacctcacttgctagcagccactgcccaaggacctgctgtgttctctggtcagctttctgctttcagcagggtcttctaaaaggtacgtctacaaggttgcagatttggaggaagaattcctgtatcctggtgaagtgttttgtgtgtgtagagtgttccagtgacaggagttatttgcaggattggcacagtctccagtgaagactctcctgtgggcttcaggagcagtaacttgcgtatgatcattgctaaaccaatggggatagccagttccatggccagccaacctgttctgtgcttcgccctataaattatgttctatattacatacaacaggatctttcacttttatttactacagaaatgtcagtaaatggttcctgatgtaattagcttgatcaggaaatgtgataactcaagagaagccgtggaatagagagagaaatgcaattgccaaatagtcactactatgtggatatgtccttgacattaggaaagccgctataatgtgtcaattaaagaaacctaggcaatgtgataattgaagtttttaattgatatagagagagaatctatttcccccttaataataacatgttgggttcactatgaatgtttaatttcctttccatgataaatagttttccctagtctgggcatggtggcccacacatatgggaggccaaggcaggaggattgcttgaggccaggagtctgagaccagcctgggcaacagagcaagacccccatcttaatttaagaacaaataataaataaataaatagttctccttttcaacagaagtttggtaatataactaattaatttgctgaatatcttttactgatgtaaatatgaatgtaactattgaatttgacaaagtgaaaaatgaaagaaatctcttagagatcatccaacccaacctctaatgttatagtgaaggaaattgcattaaacagtgttgaataacctgctcacagctggacagctagtagtttcagactggaattcagggttccatttcaagtccaaggttctttcttttttatcatctcacccttagtagtattgctatcattttgtcaaatactgagctatgcaacatgtttcccttttggccttgattttccagaactaaaaaccaaatcgtgcctgattatagtaattattccatccctagttcctgatgtaattagccccctctttagctatttgtgtctcttttatcataaccattctgggaacatgcagattgtgcttttattgtaatttactttgaattggtttaagaaatattaagggtgtaaattgtcacttaatacacacacacacacacacacacacactcttcttctcagtaagttacctggaagttgtactaatcttttaatttctctttttaaattatcttagtgatgtaaatattcatgaaacttttggatttatttgacttttggaaaagtcaaataaagcctcaattagttaaaacccagccaactcacatgctaaaccttgggatagttttcctgtatacaacatacatggaaaagaatagcaataacacagataatatcaaggaaaacagtttctgggaatagatgtatatttgatctaatccatttttgtacatgcacaccaatagttttggacaatgaaaactgattatcttagtcaataataattccatattgtatacctcattctatctaataaatcaagaaagtataaagtctgaaaatatttccctaataaggactgaaattgaaaagatctcttctttagttagaaaattcaccaagaaagtgtatttaactgaaacttcccaatcctctagagaattccagtgtattagtccattctcatgctgctatgaagaaatacccaagactgggtaatttataaaggaaagaggtttaattgattcagttctgcatggctggggaggcctcaagaaacttacaatcatggcagaagacacctcttcacagggtggcagaagagagaatgaatgcccagcaaaggggaaagccccttagaaaaccatcagatctcatgagaaccagctcactatcagcataacaggataggggaaaacaccccatgattcaattatctctacctggtccgtctgaagacacatgggagttataggaactacagttcaggatgagatatgggtggggacacagccaaaccatatcattctgcctctggcccctcccaaatctcatgtcctcacaattcaaaacaaaatcatgcccttccaaaagtcccccaaagtcttcttccagcattaactcaaaagtccaagtccaaagtctcatctgagacaaggcaagtcccttttgcctatgagcctgtaaaatcaaaagcaagttagttacttcctagatacaatgggggtacaggcattgggtaaatatacccattccaaatggcagaaattggccaaaacaaagaggctgcaagccccatgcatgtccaaaatccaatagggcagtcattaaaccttaaagttccaaaaatgtgtttcacgtctaggtcatgctgatgcaacaagtgagcgcccatgggggcagctctgcccttgtggctttacagggtacagcctacctcccagctgctttcatgggctgacattgtctgtggcctttccaggtacctggggcaagctattggtggatctaccattctgggatctgaaggatggtggccctcttctcacagttccactatgcagtgccccactggggactctgtgtgggggctctgaccccacatttcccttctgcactgccctagtgaggttctccaggagggccccacctctgcagcaaacttctacctggacatcctggcatttccatacatcttctgaaatctaggtggaggttcccaaacctcaattcttgacttctatgcacctgcaggcccaacatcacatggaatttgccaagatttggggcttgcaccctctgaagcaatggcccaagctgtacgttggccccttttagcgatggctggagtggctgggacacagggcaccaagtcccaagtctgcacacagcagaggggccctgggtccaggccaggaaaactatttttccctcctaggtctccagacctgtgatgggaggggctgccatgaaggtctctgacatgccctggggacattttccctattgtcttggtgattaacattgggttccttgttacttatgcaaatttctgcagccaacttgaatttcttcccagaaagtgggattttcttttctatcgcatcatcagatggcaaattttctaaacttttattctctgcttcttcctgaacactttgttatttacaaatttcttcctctagatactttaaatcatttctctcaaatttgaagttccacagatctctggggcagaggcaaaatgccaccagtctttttgcatagcaagagtgatctttacttcagttcccaacaagttccttatcttcatctgagaccacctcagcctggacttcaatatcagcattttcatcaaagctattcgacaagtctctagtgagttccaaactttcccacatcttcctgtcttctgagccctctaatctgtaggaagttctaaactttcccacattttcctgtcttcttctgagcccttcaacccgttccaacctctgcctgttacccagttccaaagtagcttccacattttgggatatctttatagcagcacctcactctccgtagcaccaatttattgtattagtctgttctcacactgctatgaagaaatacctgagactgggtagtttataaaagaaggaggtttaattgactcacggttctgcatggctagggaggcctcaggaaacttacaatcatggtggaacctcttcgcagggcagcaggagagggaatgagtgcccagcaaagggaaaagccctttataaaaccatcaggtcttgtgagaactaactcactatcatgagaactggatgggggaaactgccccatgattcaattatctccacctggtccctcccaagacacatgagaattatgggagctacaattcaagatgagatttgggtggagacacagccaaaccatatcatccagttaattgaaccttcacagaatttactataaccttgagtgtataagccatatttatgctaaaatgttcatttttaaaaatgaaactaatgaaaatgtcatgtattttgtaaatacccagagggggcttgcccaaggtagactgagtgggcttacttgggaaataacaaagagatgagtctggcagaaagaaattgaggatgagaaataacttgggataggctagtgatggctttgaatcccaagcagaggccctcacacttttacctggtaggctcagaagaagaaggactaatatgataactattttattttattttatcttatcttattttattttattttattttttgagatggagtttcactcttgttgcccaggctggagtgccatggcacggtctcaactcactgcaacctctgcctcccaggttcaagtgaatctcctgccttagcctcccaagtaactgggattacaggcacctgccaccatacctggctaatttttgtattttttaagtagagatgggttttcacctggttggccaggctggtctcgaactcctaacatcagatgatccacctgcctaggcctcccaaagtgctgggattacaggcatgagccactgcacccagccaggataacattttataaaaaggaatatttgttgagctaatgtacattgaggcctactttaatttcaatatacttttcagacaaggaatcacacacttgtacaattttccgaccttatcattggaacacttgctaatatgatgcagatgaagtgggattgtgataggctattttaagtacttgaattatgagacaattttcgactgcagtagcccaaatggtaccctgcagccgtcaaatgtgaggaacttcagtgtgagtgctgacaccaaatggaacctcatccacccacctgatgaaaattgatgttcccctggctgtcaccctcagctgtacgctttgctcaagaagtactttgttttgagggactttatgttgtataaaatatggttttgcctgtcatccataggtgatgaacctgccatctctgtctcctgtctctctttaaacactaacttccagttgcctatggagcaactacctggaagtctcagaggcatctcacagtcaacctgcccaaactccactctgacttccttctccaaaccttctcttccttcttcatttcccatcttaattcttagtaacccgtacattctgtcacctaggtgtgaggatgagaaatcatatttatttccttctgttcccgccacacacccacaccctgtagattctgaatcctaatatttttcaaatccatcttcttttagatctcatttttgtagtttgtgctttcactatttcttaggcctccccacctccagacttctgcctcccatctcccctcagccgtcatggtgatatttctgaaatgaaaatctgattttctggctcttctatgactttgctttccaagtttacccatcacaaagaaaatgaagccccaacttccctggaacacaaggcttctcccacctggaacacaaggcttcccatagcctgacctgtcccccactcttgctgtgtcttttaccaccctgcatccctacccacttactattttacagctcttaccacctacttgtagtcccctaaatgcatcagatctgtgagcctttccacacatggatgctgacatctgaagagttctcccttcaactctctcccatgcacaccgaatgaattctccaggcccctcctctaaagcgttccttcttcacccccagctatagtttactgcccctttatattatatgctgctcctggatgtgggacagcaggtgcatgcctgatcaaatgtggtatctttaatgatcaacaaatgtcaggtaaacagatgcatgggttagttggttccagacatagaatttactcaaaaagagagcattttttttttctcctgaatggttttcaagatagctcaatatattatgccatttttaaaattttattttctttttagattacacataataattgtacttatttaatgtggtacagtgtgatttttgtttgtttgtttgttgttattgttgctgttttttgagacacagtcttgctctgttgcccaggctgcagtgcagttgtgggatctcagctcactgcaacctcagcctcccaggttcaagcgattctcctgcctcagcctcccaagtaactgggattacaggcgtgcaccacaacgcacagctaattttgtatttttagtagagacagagtttcttcatgttggtcaggctggtcttgaactcctgacctcgtgatctgcccacctcagcctcccaaagtgctgggattacaggtgtgagccaccacacccagataagtgtgatgtttcaatacatgtatacaatgtgtaattatcaaattacagtaattagcagattcatcagctcgaacatttatcatttatttgtggtaagaacacacaaaatcttctcttctagatattttgaatagacaatatattattgttaaccattattacccaactgtgtaatggaatactcggacttattccttctacctcattgtaacattgaccagtctctccccattacccacttgcacacaaacacacacacacacacacacgcacccttcccagcaccttcccagcaccgttctactctctacttctatgagagcaatgttttagatgccacatatgagtgagactatgtgacatttggctttttgtacctggcttatttcacttaacctagtgtcctctaggttcatccatgctgctgcaaatgacaggatttcattcttttctttggctaaatactatttccttgtatacatgcataccacattttctacattcattcatccatcgatggacacttgggttgattccatgtcttgcctgttgtgaatagtgctgcagtgaacatggaagtgcacgtatctcagcttactgatttcatttgctttggatgtctacccagtatacaaccatatgattgctggatcatatagtagctctatttttcattttttaaggaacctccatacttgtttccctaatggttatagtaatttacatttccaccaacagtgtataaaaggcccccccttatccatatcctcaccagcatttgttaatttttgtctttctgataacagccattctaacgggggtgagatggtatgtcattgttgttttcatttgcatttctctgatgattagtgatgttgaagattttctcctagacctgtttgccatctgtatgtcttcttttggaaaatgtctattcagttcttttgcccattttttaatcaaatgatttggtttttgctattgagttgtttgagttccttatgtattatggatactaacccctcgtcagatgcgtcgtttgcagatatttcctcccattctgcaggctgtctcttcactctgtcgattgtttcttttgctgtgtgaagctttttagtttactgtaatcgcctttttctatttttgtgtttgtgcctgtgcctttgagttcttttctataaaatccttgcccagactaatgacacgaagtatttccactgtgctttcttcttgttgttttataactttgggtcttatggctaagtctttaaaccattttgagttgatttttttaagaggtgagaaattggggtctaatttcattcttcacgtcaagattactttgaataaaacttctaaatgaaaattttaaaagttcagccctttgctctgagtttttgtctctattctactcccacaccccccccaactttagtcactgtggaacccacagtgaggtcctctttaaagctggcttgcctgggttttagacttcctcctccttttttttttttttttttttttgagactgagttttgctcttgttgcccaggctggagtgcagtggcatgagctcagctcactgcaacctccacctcccagattcaagtgattctccagcctcagtgtcccaagtagctgggattacaggcacccaccaccatgcctggctaaattttgtgtttttagtagagacaggttttcactgtgttggccaggctggtctcaaacttctgacctcaggtgatccacccgcctcggcctcccaaagtgagtcttcctcttctttaagatctttatctctctgcctttgggtcacatctaggaaatgattcatccccccactgctcagaagcaccactcttcttgtgtctgaacatcttgggactttctaggttttaccccattgctctttcaaaaattccagatattctactttccatatgttttctttttggttgtgaatcagagagtggtagccttctcccatcgcttatgactccttctctcttgttcttcaaactcgagtacagaggctactgtggcggcgtgtttgggtgattgatgggcttcctacacttggatgttatctatgccgggcttgtcttggttacatcccagcctctccagagcaatgatgttctgctgggatctgggggctccaaagtgggctgtatgggctggggatgccagcaaatcttccatccttccatttgcttgaaattaaagatacacagaagtaatgtggccacgggggtggaaggaagggaggatggaactcaaagggaaaatgacatgtggaccctgctctcataaaatttgaaatctagtcagtggagaagaccagatgatcccacaggagaaatctggggtgtcaagtatggatacacagtgggaatgattcatgtgactcactctgctgaggaatttgcccactgccctgacacagacctcactctactggtgaggtctgcagaggctactgaatatttgtaaagagtcgagtctgcacagttggcttccagcaggcattggacagggccctccgtggaggccaggcacccggcatgcagttcccctgcctcccttggcctggagtcactgctcttctccgcaggtcactgcccccatcagctgtggtggtctagtgttcagcagaaatgggaaacggagtcttctgaggctgtgccgattgtcattgctctgaaaagagctcacttgtgcttgagtggacattgcttcagcatcaacgtgaaggcctctgtctgtgggtttcagggggtgccagggaccagactggagagcaggcctcatcctgcgcccacgtccaacctcccttatcctctcccccatgctcctgcatctgcttcccagaacctctcggcctgtaggatctgttctgttggtgaggagggagtacagcataaacacagaaggtctgtgacggagagagattgttgaggcttcctgctggaaggttgagagctgagcagaggcttacaagagggcaggatctggatagatgccaacgaaaacagagcatttgggtgaggagaagagtgaatcgatggactgaggagggaacacacctgtgctatgcccaggagaggaggcaccagcaggcagagcttccaggcagggcgccagggcagggcagcatggaggaagtggagacagtggccttgcctgtcctggaaaagcctgcgagtgtccccatcacttactagtgggggctggatagtcacacatgaggaccacaaagcagatgttatcattctcctgggccttatgtacatctcagtatgtttgggagacctgagcatttaccttgtaaaagttttctggaagaaggaaccaaggtttgatggcagagagtacatgccctgctccaggatggcagagagcacatgccccgctccagcatgtcagagagcacatgccccactccaggatggcagggccccccggctgcagcatggcaggggttccagtggacagtgggcttgggtgtttcaacagcatctcccactgcagggccccagtgccacagttgggttgaggccacagaatccattgcagatgcaggtactggctgagtgcccacagggcaaaggccatcctgaaaaaggggtgggcagccccttcaccagaacggaatgcaagtgctgagccagctgacagggtccttgactgatgggtctttcagtgagaagggtctcctgccagtgtgggcctgcagtcaccgggcagctgacgacaaaactcccagcaagaggtctttccccaataagcctcgagaagagggcagaatggggccagctgctgacgcagctgccatgtctgctggagacatgctgtgacaatgacagggaggcatccttccgtccccacctggttcttctgtatgggtctcatgagtgtgagcttctgacatcaggttccttctgagtgaggaagagaatgtgagaggtggcatcctgattaaagctgtttatggtctggtgcatttttggttaaaaatcacacttttcatttatttagcacattgctgtcaagttgcaacacgctgtaattatcagaccacaagttctggaacctgctgcgtaaggtccaatcctggctcctccttccgctaactgctgaccttgggcaaggcatttaactgcctcgtacaacctggtttcaatcccagccgcacccctgacccaccagctgctgggcaagttgcttaacagctctgtgctcctgtgtcttcatctacaaagcaggaatgatagtacctgccccatagggttatttttaaagattaagcgagttaatgctcataaagcactttcgaagtgtctgcccaacatatacaaaaatttacccgaaatacatcaaagacctaaatataagtgaaaactgtaaaaatcatagaagcgtaagggaaatgttcatgaccttggatttggcaatggatttttagctgtgacaccaaaagcataaaaaataaaagaaaaaataaaaagaagtagataagctagacctgatcataattaaaagcattaatccttaacattctagctcacatgacacctcctctgaagcctgttctaaccccttcagagagaatggattttttataagggagacagtaacagcaacagatgtgactgagcatttacttcattcaggccagccactgttttacgtactttgagttggttgactcacttgctcttcacatccatttaagattagattctattggccatgcacagtggctcacacctctaatcccaacacttgtgaagccaaggcaggaggatcacttgaggccaggagttcaagaccagcctaggcaacatagtgagaccccatctctaccaaaaaaaaaaaaaaaagatacagatagatagatatatagatagatgcctggccgtggtggtgtgtgcctgtggtcccagctacctgggaggctgaggcaggaggattgcttgagcccaggaggttgaggctgcagtgagctatgatcacaccactgcactccagcctgcacaacagagaaagaccctgccttccaaaaacaacaacaacaaaagatgaggttttattattatctctgctgacaaatggagaaactgaggcagataacagtccagcagctggcccaggccatgcagcacatcctctgtgctcccagcacgtgttgcagacaccatcgtgtagtctggagcacactgagctggttagatccagattcccactgtgaatgggaactccttagggccaatgacatccctaaccctgaatcatgggacctcaatgacttctgcaggactgaaagttacatcttgattctggagggatttgggtcgcagactagagatttaaactttattctgaagtaagcagaaagttatttcagatttttaaaaaatacatgagaaaaatcgtgtttcagtaaagacaaatctggtgtgcaacgtatgagataaatcaggggcggcagcaggaggcagggagttgagtgagggtggcccacggttgtgagtggctccaggtgggtggggtgaggccttggggatggtgcgtggactaatccagatagtgaaggccacacgtagggaggcttcaagtccctttaggaacaagaatctcaggaactcagaggagcctgagtgctctgccagccatgcacatggtggataaaaagtaaaaattcagtcactcacccaatatttgatctcagcatccaggatttctcagcctcttgggggttagcatcgcaaaaccacaggcagaacttgatgccttccatcttcttttcttcagatatcttaatctgaatatcaaaaggagaatgtgaggcacagtggcttatgcctgtaatcccagcactttgggaggctgaggtgggtggatcacttgggctcaggagtttgagaccagcctgggcatcatggcaaaaccccatctacaaaaaatacaaaaattagccaggagtggtggctggcatctgtagtcccagctacttgggaggctcagtgggaggattgcttaagcccaggaaacaggtttacagtgagctgagactgagccactgcactccagcctgggtgacagagcaagactcctttctctcaaaaaaaggaaaatgtgaaagatcttcaaagcaaaatacactcttctttatagcttgttctttcattttccttccattagaaataaaaccaaagcaaaaaaagaggatttaatatccatcatagcaaactttactaactgaaaataataattggctatggtctgatttgattcaaaaatccattgtaggcttacaacacatttatttttaaaaaaaaaaaaagctaaaacttagtaatacatcttacccttaggcaaactcataagaacagctgctgaaattaaattaggttgtatacttgtttctggaagttttccacctcatttctggctgaagtgaatccttgaagaaccaggagggctgagcagaaaacaaatatttgccactgctttcagatccatccctctgtgggaacaatctggagaaactgcctttttcatattttcagtaaaaaaaattccatattcatgccatttcctgtattatgcaaaataccttccctccatagtctcttaaatgacactgcaatatttttcctagaatttcctaaaagaaaacagctggtttgatccccactcttggtccgcatgcctgatttctgtagacactgggtatttgcagtctgggctgcatcagtttgtgaggtacccataaggatgtgggcagagagtttagagacagaaaacccagggcagaattgatccatgcaccagaaaatgcattgtgtaggacaatttatagcttaggagcttcaggagacatgaggtggttcctgggtcacaggttctcaaatttggctgcatattgtaatcacctgggatgtttctttaaaatgctgatgcctggattccattcctagagattctgactttgggttggtctggtggattgtgcattaggtttttcaaaagctccccaggccatgtaatatgtatcaaaatctgaggaccaccaacatagaccatctccccctcctccccagagagggggcgacttgcccaaggtcagaattataatatcttccagtgtaccccaactctgcagatggttctctatcacccagtggcccaagagatcagtttgagaacaactttgcctcatcccacaacttcaccccagacctcaggtcacttcccatggtcaatgggttcttctcatagtctcaatggctgatccttctccatctccatggttagtgctcctcagatgatagcaacaggctcctctcatttgaggcctggctcccttctcttcgccacaccatctgcctccatactcatcttcaggagacttgagtgtaaacatgttgcctcctactcacacctctgtcaggggcttcccattgcctttgggacaccttaatgtggcttccagaccctccaggagctggctcctggcctcctgagtatcccatcttgcccctcctgtatgattccgcttgtatgaggtccctggagttgtcagacccctagagacaggaagtagagtaggggtgccaggggctgggggagggatggggagttacaatagtatttaacggggacagagtttcagtctgggaagagggaaaggttctgcagatggatggtggtgatggttgcacaaaaatatgagcatacttaatgcactgaactggacacttaaaatggttaaaatggcaaattgtatgtaatgcatattttatcagaacagtaaatttttttcaatagctttctgagaaagaccttgcctgccctttgcctgagttaggcagctctgttttgtgtttccagaactccacaatcttcctatcagaccactgtcctgcttagagtctggcctttttacagattgtgactagaataaaggcgcattggagttctcgcctatttaccactgtgatcccccatgactgcagagtaggtgcccactgcataattgttaatgaatgttgttgaatgaataaaacccagaactacagtgtcccagcccgtcaatcttaattgctaggaaaaattggattgcaaaaataatccaatttgatattgtattagtccattcttacattgctctaaagaactacccaagactggatcatttataaagaaaagaggtttaattgacacactgttctgctggctgtacaggaagcatggctggagaggcctcagaaaacttttaatcattgtagaggggaagcaggcacatcttacatgggggagcaagagaaagagagtgaagggggagtgctatacacttttaaacagccagatctcatgagaattcactcactatcaagaagagcaaggggaaaatccacccccatgatccattcacctcccaccaggccccacctccaatattagggattacaatttgacatgagatttgggtggggtcacaaatccaaaccatatcattccactcctgtcccctcccagatctcatgtcctgctcccatttcaaaatacaatcatgccttcccaacaatctcccaaagtcttaactcattccagcattaacccaaaagtccaagtccaaagtcttatctgaggcaaggcaagttttttctgcctataagcctgtaaaatcaaaagcaagatagttccttccaaaatacaatggggacacaggcattgggtaaatactcccattccaaatgggagaaactggccaaaacaaagggctacaggccacatgcaagtctgaaacccagcagggcagtcattagatcttaaagctccaaaatgatctccattgactccatgactcatatccagtgcatgctgatacagcagtggtctccatgatcttgggccactctgccctgtagctctgcagggttcagcttcctcagctgctttcacagggtggcattgagtgcctggggcttttccagatgcatgctgcaagctgtcagtggatctaccattctagggtctggaagacagtggccctcttctcacagctccactaggcagtgccccagtggggtctctgtgtgaaggctccaaccccacatttcccctctgcactgccccagtagaggatctccatgagggcttcaccccacaacagacttctgcctggacttccaggcatttcatacatcctgaaatttaggtggatactcccaagcctcaactctcacactctgcacacccacaggcttaataccaagtggaagccaccaagacttggggcttgcaccctctgaagcaacagcctgagctgtaccttggcctcttttagccatggctggagctggtgtgggcgcaatgcagggcaccaaggctgcacagagaagtgggactctgagcccggcccatgaaaccattctttcctcctaggcctccaggcctgtgatgggaggggctgcctcaaagttctctgaaatgccttggaggcgttttccttattgtcttggtgattaatatttggttccttttacttatgcaaatttctgtagcaggcttgaattcctccctagaaagtgagtttttctcttctaccacatagtcggactgcaaattttccaaacttttatgctcagcttccctttttaaatataaattccagtttccaatcatctatttgctcatgcataacaaaagtgaccttggctgccattctcaataagttccttatctccatctgagaccatctcagcctggacttcattgtctatatcactatcagcattttggtcacaaccatccaacaattctctaggaagtttcaaactttccctcatctctctgtcttctgagtccttcaacctgttccaacctctgcctattaccaagttccagagtcacttccacattttcaggtatctttgtaagaatggccccttctcagtaccagttttctgtattcattcccacattgctctaaagaactacctgagacttggtaatttattttaaaaagaggtttaattgactcatgattctgcaggctacatagaaagcatggttggggaggcctcaggaaactttcaatcatggtggaaggtgaagggaagcaggcacaacttacatggctggaggaggaggaagagagcacagggggagggctacacacttttaaacagccaaatcttgtgagaactccctcactatcatgagaacagcaagggagaaatctagccccatgatccagtcacctcctaccaggctcagcctccaacattggagattacaatttgacatgagatttggacggggacacaaatccaaaccatatcagattttaagtagctagaagtatcagaccacaaattgtccagtcatggtaagtgataacattgggtgaagaatgtggaatttcagcctctgattaatccttacaggtatattctgttcgaggtgggtagacctccaagaattttgagactgcctttgttctgtctaataaatacaacaggaaaatgaaaacccggttgatgatttcagattttttaagaacagcctatttataaccacttccttgcttaatattatgcttttttctctttccaaattagatatttatttttgaaaacaatatctactactgtgcacatgtcgggaaacaggccatccgtgtggtctccactggcaaggaaggtgtgatttacaatggcctcagtgactggctgtatgaaggtaagatgtgcacagagagaaaaaaggaagatttgtggttgctgctgctgctacattggagttgggttctttttcatttttctttgactttaactgtaaattaaactccagtttcttgaggttctgcaaaatttaaaagattttgttagagcttttgggatcaggctgatcagcatcagagaacagcatcaggctgttgtcaggggcctgcagtgttgtgcactcacctgggacaggtgtgctggctttgggctttgcagagctctgcaattcatccctgaagggcaggaggctcgttaatgggagatttattatgtcaggaggtgacttctgggaacgctcagggactgcaaatgcatgtgtctctaccccactccaagacataagtgcctcgttttgccttgggaaggggacagttggaaaagaaagaatgagttgcatctttccaaataaatcatcagagtgacttgctgctgagagcgcctccaccttgctggacattttctaccactggtttgcctttggcaccagaagactcatgctgtatacattattaaataactagaagtcagagggggaagctctcttcttaaactttgataacctgtctccatgctcatgacccttcatcgtaacaataacaaccaggtattgattgctattagctgtcaggcactgctggaagcactttgttttctgttacttcattccaccctctgtcttagtttgttcaggctgctgtaacaagatataacaagattccacagactaggtagcttaaacaatgaatatgtatttctcacagctctgaagcctgggaagtccaagatcagggtgctggcagacccactgtctggtgagggctctcctcctcacttgtacatggctgtcttcttatgtcctcacctggcagagtagagagagctctggtctttttatctctttataagggcacaaatctttttatctttttatctctttataagggcatgaatcccattcataggggcaacaccctcataacctcatcaccttacaaaggctccacctcctaaccccatcaccttagggatttgggtttcaatatatgaatttggggggacacagacattcagttcatagtactgtcataacaaggttctattttatagatgaggcatggttaggttaaataattggcccaagtttacacaaggtaaggaatatttattggggaaaggcgttgtccaagctcagggtaattaccttttttgaattccacatgtggctacagtaaccgtatgctttccagcatggggctgatgaacaacccaagctcttctcagcctcctggcctgaaaccgtgtggtcacagcaataactcaccctgctaggctgggtcaagggagggtcagggagattctgggtgctttctcaagccagtatcactttctcctagtgctgtgcatgcctcattctgcattttagtggctttatgcatcataaattataaagcagatggatatgcaagcttagtgttacctcctaggataatttctctgaagccataaagttctatgacttgatttttaatttttgtaaatggaggtataatttgtacataataaaatgtacatcagaaggacagtttgatgagtttggcaaatgtatatactatatagccccagtcaagacatagaccatttccatcagtctagaatattcctacaagtccctttccaagggctttctccctaaatctgtcttccagagactgccacggtcctgggggctaagcagcccattctctaacagacatactggaacccaagcatccacatgaggctgtccttccctgtgtggtcaccatggaagccccatgtttattccaatgtggctgccggtgctcagagcatgctgaagagtccagtttccttctgagccccaggagaatcaaccctgagattttattgtcacatgagtccttggctacacctgaaaaagccactggaatgaaagaggggacacagtctgctgtagttatgcctgttctgtgcagaaacagccctagaaatggtgtgcccggagatgtccccagctccaccaaagaggtacaggcagcagcacaaagggaagctccggaggggctgcacctctgcctggggtgcaatccctgagcctctggggcttgcctgccccctggactcagtagactgttgacaatgaggactctaaagccccttgtgtgctgcccttttgtgagaaaaaggccttatacctaggagcaactggaaaactgggtcctgtttgctccctgatatctgagatcccactaacagctcttttgcttgggtgtgagatcagctcaatatctggatagggaagggaacccaggggctggagatcagaacatgagtggttcaaagtaaggctgtggagctgcagggacccagggaggagacctggcccagtcacgggacatgacaagggtcttccactccatcgacctcaacatgctcatgtgtacatgggaagaatgccccaaacactacacttcctgaggactgtgtgagacttggagtggaatacgtgcagcacatgacatggtcagcaagggacagttgctgctgttgtttcttatcacaataaaaataacaataattatgtatttattactattattgtaattatttgttagtagtatttttatcacaaaggaaaaaagatgtttaaaaaagaaaaaaatggcatagatatcaaggcaatgttacccaggtggtcattctgccacagggcagaaattgtctgacctgaaaattcaagagagatcagtgcaaataataatgaacccaaggtgtgtcccccgtccctaagagaaagggcccctagaattttggctgcaagagcctaggcattctctgggactaatctccctcaaaaatccataaccaggagatttaaaatatcttttttagtatcttcttaataaaataaaaagttcattgctttgccattcacattaagcttttgctttagcaaatccattgaaaggacttttttcttcaaggcatttacacgaaattgtgttgatgtgataacagagccctaaatattttaaatcaatcacagttgatgtggcagcttaatctacttagtgttgttccctggaaggtttatatgctgatgcttagatttctgaggctgggagcacaggagccctgaggattcttgcttccttttttaataatgggaaagtaaactttgatgatcgcttttgcctactctgtgacttaactgtttcaattccaaacacttcctttaaaaaagttagggggtggggggagattagaatgaaaatgccctaaagcatttgcagaggggctcatttgcttggagatgttagttctaagaagataagctgtgtacgtgggaaacagccactgcagtccatagcttgttggcagaaaaatgccttattgatttgttttgtttcccagaaaggatcttaaacatactaaacattgcaaaatattggagactgaggaagagaagaggtgggcagccatagaggcttctgggagtctccaacccttgacctaagctttaaacacacaaagtgggaaaagctccagtttactgaagcagtcgcccacatgccagaatgtgagctcaacactggctgtgaactcagcactggctgtgaactcatcactggctgtgaactcagtgtatctgtcttgctgattctctaaagagagtcctgtggctcatggtggccacaaactgattttgataagcaaaatgcatatcttcattttattcttctgggaaaatgtcataaaattacatcgaattttgattttaataaaaactaaagacagcttaatagagtcctacaactttttaaagtttattaaagtttgtttattcataaactaaacgtaagatgttactgaagatgaagattttgaggcctgtgagtgagtgttctgttaagaatgtgcactttgatgcagggctcagtaattttgcaaagttcctagtatgtaggcatatgggcaaagagttggaattctccaagttttgatgaaagttctttgttaccgccattacatggttgattgtgtttccagctgccactctttgtttataaattactctttgtttttcttttgtttgtttttttttttgagatggagtcttgctttgtcacccaggctggagtgtagtggcgcaatctcggctcactgcaagctccgcctcccagggtcacaccattctcctgcctcagcctcctgagtagctgggactaacaggcgcctgccaccatgcccggctaattttttttttttggtatttttagtagaggtggggtttcaccgtgttagccaggatggtctcagtcatcttcgttatcatcatatgcatgagctatagtgggacagcacagaatttttggccaataatttgctaataatgactttaagttattaaatatttcagctaaacaatgagtcatccatacttcttttaccaaagcagtcacatgcatatgcatatccaaaatacatataattattcagtgatatgccattatcatggaatgactcacagccctgtggaaagctggaacatgttagggtcattggaggacaacatctttccttatgtatataaaagatcttatcccctcaaagggcagtggaggtagagtgagggatgatgaactcgagaagatatttatagagctcagcctggagtcatcagcctgggatggcagggaaagtgagaaaagggcccgaagggtatttatttcatatctggtttggcatggatgaaattccagggctggattttccttaactagtcaagaacataaaagtacttgaaaaatgtgatcagatcaggagacccagtttggcacggaagcatttccccgtgcatgtcagcaggaatcatgttagatgagactctcgaagctgcccctggcactagttccccttgcgtggttctaggacccatgcagtcaggcagcccctgacaaggagtagctgctgggaagtctcctgccaacaatactcacttctgctccaccctgcccagtccaccgccctcgcctggactccatggcaccctccccattttctgcagccctgccctgactcctgaggcccccttctcccagtcacagcccttgccacagtccccacggagccaccgtcctggttccacctacctgggagcccccaagagagactgtcttcactgtcccacactaactgccaccttcactgggtggccagcatggaggaagtggggatgtggctagtctggccagaaaggacttccttccagaactgctgctgctggagaggggtttagtgcctcttgagttggaactcagaatgctctcattagcgatgtagtcaggcccactgtacaaggagcagagcctttcctaagctagggccctcagtcctgctggatgagcaccaaaccctggtggtgtgaccattaccctccatctgtgtgtcctgctcatgtctagggactgcaaggccagcgtgaggcaaggcctgctttgcacttctttatagtttctcaaagcatctttaaagagtcagcactcatgacctaatagttttctgttccaatgaagtgctctaagaggtaccagcaaaaggtcaggtgggccccaggcagataaatttgagttaatgaattttgggggtggggcaattccatgctttattgtcttgagtattcaaggaggtggagagtgtgtaggagtagtagtgcagtgtagtagatcacagtggattttcacactttcatggaagaaaacacattattaaaatgaaagccctcctggggatcgtggaatggttttcagggtctgttttccacagggggcacattcaccaaaagaaaagggaactctttgttcatccagattcccataaactctctaaatcccatgaaagcagaacaaacttaagtaacacttcacgtgaaacttgcatattggctttaatttacattcatgacacgttagatatgttgtacactttgtgtgccttgtgtcacgctgatacccagtgtgctgagtacctgcttcctgcgtgttgtgaacagaccagagccagttgtgaccatcgataactggtacagtcttcagtgaatagcggcagccttggacggttcgacgcagatgaagaaaatctagcacaccatctttttatctaagaaagcaatatgctggaaccattagacattaatgacacttatgctacttttctttagagacaggctctcactatgttgcccaggctggcctcaaacttgtgtgctcctggcttcgcctcctgagcagctgggactgcaggaacctgccactgagccccaaccttttatgctgtttttaaaactccctgacatacatttggagactgatatgtgaggtgcttacagaagccccctggagtgtagattcttgattgggttctgcaaatattaactgcctctgaagcacctggctagggcacttcaactgctagcaaactgctcccaggtagtagatcaaagtggatttttacacccgtcatacatcttagtgaccatactgatgttttttaaataagttatggagcaggcagtacaatgggaattggaatgatgttcaaatatgtacattactatgtaaaccatagatctgtagttatttggacctcttattgattacatctcttatttgcatgatgggaaatgtttggttagacaaggacatcactctcagtaaattggcagaaacttgtgattagcttgacaaagctcctttgtggaagagcagggcagagtctttgtagtgatgatgcctgtgtttaaacaaaagcttcaccacgtaaaagctgtatgaacttggatgaatatttgacctctttgtgtctctgctgccttgtctgcaaaacaaagataacagcagtatatgctccataaggtcacagaggaaattgaaataagctaatacacatagagctcttagaatagtgcctgccactggtaacgtctacgtattggtggtacaactactattgctttaccttgtaatttcccaaactcggtaaaataagaggcacctgctcaactatttcatttgcaatgtcaggaatcggaagcattaatgtgtaattaatgatacctatcagtgttgaaaactctgaagctctattcactcataaaatattatctgtagtatgttcacatagaaaatgcactatgagttcccagtcatcctagaaatgctattgataccatgttgaacacctcttcaagagccttctgtccacgtttagattctccaagctgaaatcacacccttagttgccactgatgcctgacagagagacagctgttttccttttatgagccccaaagttcttgtgacttggtaaaaattatgcctcatgatctcttacagaaattgagtacttaaaaaaattatattccacttcatctatgacttctaagggaggatatgaaagtaaaagtaatgatgaaaatatctaaaatgtaatcagtgtctggcgaagctatcagacctatgaggtactgtgcaatggagcattggctcaatcaaatagcaatcattctgagcaggagtctgaatgctttgggtatttcatgtaactaaaatgagtattttccttgtctagtcctagtctccaactctgtaaagtattaatgatcttgacttgaagaacatgttaattttaccttgtagagagacaaggaggaaaagccaagaagctgtttggtagaagttcagttggctctgaccagaaaatggctgagatggcctaagagttccattccttctgtgcttctctgaacctgtgagagatttctgggtttctagatttctgcaaggatcaacaggaaaacagtgttctaaggcaggaaataagaatgtcaggagcataacatagactgtgattgccacaggtaagccaggctggctgccaaggccctcttagccccctgggtccaactgcacctgttcctcacttgaccctgagtcccaccagaccctcccctgccatcgtctgctctcaacgtagcaatcatggcatcatggctgcctcagtgccaaactttaaatccaggtaggtcaccaggaaacaccagcacatcctaaccagcaccatctctctgtttctgcgatcatgggcagaccactatctttctgctgtaacaacacaaagtgtatgccctcacttgcctatgttcatctgagttttcttgaaagaaaaacacatggctattgattctctaatcacagaaggaggtagtgttggagctgaaatggacgttagcagacattgagtccagcagtcagtaaactgtttctgtaaatggctaatagagtctgggtaatagagtcagggttttgcaggacatatggtcttcattgccactgctcaagcctgttgtcatagcaaaacagcagccatacaccataagcatggctgtgttccaataaactttatttgtggacagcgaaatttgaatttcttgtaattctcacatgtcattaaatattcttcttttttaccagctattaaaaaacacaaaaccaattcttagctctcaggtcatacaaaagagacagcaagccagatttggcccaaaagccatagtaagccaatcccaatttgtccagtcatcacattcacagacgaggctactgacatcatgtctgaattcttccagctcttgtcgtctgtatcaagatcatttgtaatgacaaccaattatttcaaattttgcttctccaaataagtctagttacttgaagtcaagaactgtattttatattgtatgtttcccataacaccagtgactctctgagtacttaataaatgttcagaaaatacttttgaatgagttaattcacagagagaaactcacatattctaggaacctccacaaggaaatcatattgtttctccatgatcactcttattagaatttccatttccacaaaattccctcaacagaaaaacacctgattaacaaaaagcaacagtaattgttaacctcgttttaattatgagtttcacgttttatccccaaggataaaggaaaaaactggagtgacgttgggaaggacatggtcttcttaccgtgagcccaggggcacaggatcatagctcatcagactctagaccatctaaattcatgctaagtcatagttcacatactgaatgaatagagtaggaatagcagtatctaagtttcagtgagtctttcttccatgccaggccttacacaaataaacttcgagagcgctatgaagaaagctctaggattgttccttggtatcctcgggagactggttccaggaaccccactgcacccacccttcttcaatcagataccagagtctgaggatgctcaagttccttgtgtgaaatggcttagcatttgcctattacccgtgctcatcctccgggatactttaaatcatctctaaatcacttataaatacctaacaccatgcaaagcctatgtaaatagttgatatgctgtattttttatttgtaatattttttatggtcacactgttatttttttctttaatatttttgatctgcatttggtgggagggtctagagatgtggaatttttagacacagagggccaactctttccttatcctattgcacagctgtggaaactattaagtggcctttctgtggacaaacaaccagtagggagcctgcctgaagctgctaagcactttcctgctgcatatgagttgcattaatttcttgcctatgaaattaggcttgggtccatactcaagttctgggtgcagcatcctgtagatgtgtctgctcaatgccccaggcttgaaccatctgtgctgtaaaaggtgtgtctcatggcacagatttaagagcccaacagaccttgatttaagccctctgtgagccattcagctgcctggtgaccaaatcacaaaccttgtctgaccctcagtttcctggtctggatgataaaacttcaggcacctttctcaaagaattattgcaaagttaaacaagagcgcttctgtggaagcgcaggcatattacagtggaaccataagaaattgccaacaggttcattgtatattagcatgtgcatgtgagatgtccggtgaaggtcaactttcttctcccatcctgctggctatgctggatgagatctcagatatggtaaagtctcagatgtctgcgtgcccagcacagagaatttaccatggaaaaggcgggggtattttttgactggaaggtcagacctattcacctccaggtatagcatctccagggcccccccagcaaacaggagataaaagggatgactgctctcctggtctgtgggtttctcccaagagaaacttgacagagacttccttgctccaaatcttcctcttcgtggctccttgtttctggtactgattcccaccaccctcctaattgccatggtgaccagtcggtttgctatttaattaatgttgtatctgattacatctgtaccctgggagttctccagccaagagttgcaatttaaactcagaaataaataaaacgttcagctgtgaggatgggggaattatcctagtcaatcccggaatattcttccgacctttcttagatgaaaaattatctggtggaagttggagtgaggcagtagtacacaatgaagaaggaacaatattctgcttttggaatatttaaaaggaagcctcagacagcagctaggggtcctgcttagcggatagagctttggaaagaggaaatattagaaatttggttgagaattttctatgaagttcagtgctaagagcagagaccacaacttaggctttgcagccagcattcccttccataaacttcaaacgtaagcctgatcagaacaaggctagcaggaagatgtgctggtggggacaggctaggtcctgctgtgggtagcaaaaaacaaacaaaagcaaacagaacactgcctctaatttaaaacagcaaagtgtatttctcgtcggagatcactcaagcccactctagatcagggatggggaggaggtgaggctctttccctcacggtcactcaaggtcccaggctgctggggctgtcctcttaggcatcgcagccacactagtggaaaggggagtgttccggagggacacaagctggggaataaatgcttggcctgggaatgaccctggcacttctacgcatgactcattgtccagaacacctcatatggtcccaccagggttccaggaagtagcactgagccattgtccagaagagggggaggccagacatgtctgggaggcaggactgaagaccccacatctgggcagctttcttgccaacagtgggcctcaagtttggtgcccaaagcagaagaggaattgtctagagggatgttggggaatctctcagaatcaacaggaagatcagagttgggttgagaaagcaggcagccgtccagggcagctgaggggacgccaggggtccatctggttgggacactgctgtgggggaatgggagtatgggagaggcattgtctgcccggatcacaaatgacgttcttgaatgagctgcaaatagaaatgccatgtcccccatggaatcatcaatatggcaacttgggaagcgtattccaggaaaaagctagggtgtgtaacgttttattgttgcaaactctatcatttcacacttaaatgataatcgcaaggagagccatcagaaccattagtcatcatctcttcaatgcgaaggttcgtaattgtcacatgcaccttgcaataaggcaccttgcaataagctcccttccttcttggcatctccttggagcctgtgaagtgatgaatgcagttcccaatgcacagccctcaaactgcatgggagaaaccccagtgtcccagaggacagtgggggcggcttcagcgtggctgtgtggcactgaaacaggttaaccgcaaacctctagttctcagaaccaaagctgaatccacatttgaaaatccagtagaagctttgttaatattttaggaaggctattgagtattttaattcaacatgaagaggtgatctagctggtcttgtgaaaaatcagtaataaatctaaagggagaatgttctctaaaggtacaggaagaattctcattggtcttgagaaatgtccttacaattaatgacctactcctgagagatcgtgacaaatatcttaggatgttcagtgactatatttttctatctttcaaattatgcatttcattgtgagattaggacaaacacacttttacctttttttatagcgccctaatgaaacttatgtatttgaggttgagatatttgacacccttgggaactctaatttcttttttttttttttccgtcttcttaagtcacctaaggacattagaccatttgccctattattgagagttttactaaaatgcaagctgcaaatgccagaaggaagataggcaacaagacaatatgtacttaaaagagtttcatttgatactcagaagctggaactagacttagctcttttgctcactaaacctgtattctaacctttttgggcctcagtgtctttttcttgttctggaagcatcactagggtggaccagataatgctaaactcctttccgtctctaacccttttcatgtttaattatcagtgccataagcacacagcgttgatggtatgaagtctgtgtccatgccagataacttcacaaggaaatagttaacaattctcggttttacttagtaaacatacgggagcaatgctcctcagttgcaatggtgggggctgggcacgtgggtatctcggcctttttgtccccttcctctcccctttcgtcacccccacacacaggacatttgcgtactgggagaacctttattagatgattctgataaaccttctccttatccccacgtgaaacctatctgccctaaaggaatcagtcttctgtctcctttactccccatttttttctttctataaaatttgcattattggcataacttttctctttactatgggttatctttgggaaggtgtaagggaatgcaaagatagctcacctccacgtcagagctccctgcacttgcaggcgtggagaggacatacccttcgtcactcgttctgtgcgttaggaccagagtggaagaggatgcgaggagtcagatttcaggtcagttgctcttccccagccttcaagcaatggcagaggctgtcctgggaaggtcatgctcttctgtctgggttatctgaagtgatcattgcaccgagtgggagactggacatgcagacctatcatctgcagccatacaagctcatgattctgggcaccctgagtcaagtcccagagcccaggcaacctggcagaacccaggaagggtgaagcctctgcatgctggccactcaggcctacgattagcccctccccagcacatccgtgcattcagcgcaaggccaagctccatccagtcgatggaaatgggcacctgagcctcagaaacacccaaagaagagagcacctttcagctcttcatggaagaaagcgagccagccagcaccttcttctttttgcaggaataaatatgtctggcacctggattattttatttaaaaggccagctgtgtggacaccatgcctataaagtattgggatttttaatgaatgttaaccaaggaagagcccagctaggatacttcctgtaggtgtcactttgtggaggtcttaggtgctatccaaccctaaggacaaggcagccaggccagctgaaggatttcagatcagctctttctctgctcaccaccctcattattatccacttcttttatgggtccactcagatgctcatgctcacagtcttacctcccttctctccatccagaaaggtgaaacctcacccaccgccatgtggctcccacatcccagtgtcctgcatctgtgtctccagaaacatggcagagatagaagaaatttacatgtagcaaaattcatctcttcaagaagatattccaacacctgacagtggcccacacagtcctcatttactagggaatcctatttcgagccccttctgggcgcccagattggatgagtcactatggattgcagtgccccacccaacggggtacctgaaaaagaggaagaaagggaggcagggagggaaggagatgaaggaggtccaagacagggacccttcccttgaggaactgatacacagtcagtccgatggaggccaagaccacctgcaggaagcagctccttccttccattattcgagtgggattcatgcatttattctgcaccgaagccctctaccaggtcctccaagggagacagagatgctttaagatctggacctgccttcacaaagtgtatatcctgcaagatggtattgaaccacatcctaattacatggcacaaatctttcacacatttagacacttttggcagaatggtatcttctgatttaaaactgcagaaacatgaaaattagaaaaccaaacaaccattaatgcattaactcaagagttcattcctaaaatccaaatttccttctctggagataggaccagatcatagctcccaatcttttctccagtttttgttttacgacatttcggatttgagattctgtaagaagtgacctaatgtgagcatttcctgatatggaggagacgcaaaatagctcagggaaaaagttgatcattagaaaaatctgtggttgtcccactgtctcatcgtgccactgggagtttctggcctccgctggcatctctgatgaatgttctatgccaggacaaagaaggcgggcatgggccaggcagtccctccagtcagggaacggtggcctctcccagctgccttggtgtttaggaggccctgtaagggtatttgggatctcaagagcctctgggacttacgggcaaagggcagaccttaagagccagtccctcctcccccaaaatgtttagcaagccagaaattcccctttactgctaagtcaaaggaagatgttctttgactcttcagggagcataacgtaccatcctttgatggtcatacacattaaaagaagataaagccagaaataaaagggaaagaaacagttatatgattttggtgggaatttgcagaaatacaggctgaagctgaagtcttccatcaggtgaggttttttccattgatctcatctctcgggctcagctcttttatctccagcgcattttggatgtggcttctctttccacctgctgggcctttagatagagtacttccttttgtttcaaggtagcatttaactgagtctggaaaaaccatcattaagggaaaataaagctgaaagatgaattgaaaactatgtaaaagggccctttcaggctgccggagagattgcctttccagcctaatgagcctgtgctgcctctgattcagatggtgcaaggacaggagaaaagaatggagttttgtgcactgcgattttccaaagcacataatgcttagtcatttggggtgttaggaaagagagaaagtcggagcggagtgtgtggtgaagtgagagaaagaaagaaggctgaattttcgttaagctgctcaaatgcctgctttaacaaaagtctgccagggctagaggtgattagccatcagtgctgctgctgtttttgctgtcgtttttgctgttgctgaagtttaaaggtcctgtgccccttggtatatacgcaggggattggttccaggacccctgcattaccaaaattcaaacatactccagtcccagtcagccctgaggacccaggtatatgaaggggtatatacgcaggggattggttccaggacccctgagttaccaaaattcaaacatactccagtcccagtcagccctgaggacccaggtatatgaaaagtcagtcctccatatacagggatttcacatccctcaaatactgtactttccatatgtatttggttgaaaaaatctgcacataagtcgacccacgcagttcaaacctatattgttcaagggtctgctgtcccgtccttatgtgggatggtgacaagcggccctgtgtcccatggcgtgcagctgagcggccttggtgcagaggtggatttgcagccagttgtccacacatcctggatcctcccggtgcgtcctgtgtaatgggttaactggacctgcctaagcctgggcctcccacccctcaaaagcagcttctccaagctttcctacttaaatttctccagccacagagagaagcatttattgtctctcaccacacccgccccccagtatagaagaaaggaagactggggaattgatctctcagagcacttggagaagccacacgtcagcagccagtaaagctagaatgaaaatctgagcgatcaaggcaatggaatagaaagtcaaaacccaaacttcatctcttccccactaaaggaacgggaagggacactgccacctggcggccagccgaggcatgttcggggagccgatcctcctccctgggccccccacggtgttgatttgtgggaatttgcagatctctgatgataatgaggggattcgcagtgtgtgatatgcaaataacacagctctgattagtgaaggaggctgcgagccttgcaaggtaaaagctccatttgccttctggcttgatgttcgctgatttcttttttaaccccccatttaattctgctctcggcaccttggataaaatatttagtggcaggaaaaaggcaacagatgcaagcaggaataaataagattttctgtatttagaatgaggccacgtatttcggagcacagatctatcaggcatgttatttatgtcttttgcaatttcccgggacccagatttctcagggtgctttgatttttctcaaatatctacagcagtaggggtccagggagcccagggagcacagccaggcactcactcacagtcagaatccagggggctgtgttatttaggatgatccgaaacgcgaccttgctgcctgcattctgttttgatatgtatcttgcctcattaaaagatgacaatctgcaatactgatattactcaggcagatggatttcccaaatgctgggctatagcctgggctgccagactgcatgaggtttaacatggaaaattaactgcagtcttgttctctggtctgccaggtccagcagtgtagtggaaggagcaaaggagcaggaatcaggagactcaccaggatctgccctctcctgtcctgtgatcctgagaaaatggcttggtctcctcatcctggaggtctccatagtggagtgggctcaacatcacacctggagtcaagtcaaggctccgcacgtcccagtgacctagagccagttgtcaacatctctgagcctcaaaattctcctttataacaaataatgtaagcagatccacagtcactaggaagattacaatagaattgccagagtatctagcattcagtaaatatttattaactagatagaaaaaaaatgtaccaggcttagtaacacccggccttcccatctcattagaggctagaatgctcaatggacacagggtgtgtcttagtctgttttgtgttgccataaaggaatacctgaaactgggcaatttataaaaagaagagtttatttgcctcagggttctatagcctgtgcaagacacatgcaccagcacctgcttagcttctggtgaggcctcaggctgcttctactcatggcagaagatgaagtggagctggttgtacagagatcacatagtgagagagaaagcaacagggtgtttaggaggtgccaggctcttttataacagcccgccctcacaggagtgaaatcaagcgagaactcactcacccttgggggaggccattaaccttttcatgaaaaatccacccccatgacccacacacctcccactagaccccacctcccatgacccacacacctcccactagaccccacctccaacattggggatcaaatttcaacacgaagtttggaggggacaggaagccaggccatagcagggcatatagcattggcatcaaagctagggtgttgattggttatgaatattgttggtcctgcctcatttatcaaggaaagaagaaaaaagaagactgtagaaagactaagttcagggtatacatgagtcttcaagagaagccagacaacattccaggatttcagaaaggggacatggctgagctgggtcttctctttgtggggagacatgtcattgggcctctgagttccaaagacacaacctggaaaaagcacaaaaagactgtctacttagaagatttaggatttcccgcatagtccccagggcctcctctgatcctttgaccaagatatgaaagccctgccatataagaagaggggagctccatgctgaggttaggacacagcactgatatgatgccggccttccttggtctatttgacacctaatgaggtggggacttgttgacaaagtccttccatcgtgaggtctgcacccctcacccccagcttgattgtaccattctgttttggaaatccccaccagaagtaccagcaaatgcttcttaagcttctagaaatttctatctgggattattttgttcatagagcaattctggcagccagagttacttctgcatctttgctttggaccacaatcacccaaaaagcattaggagaaaagagatcacagcaatggttcactcaattttcaacttccctatgctgtttagattttggcaaaagagtattcactgtgactgctgcttttcactataaaaagaagctgagatttcctgccaactatttcacaaaaacaaacagaagattcattgagagaaccaaggaagcatctgatcctacaacacacgaccaaaatatactgtctgtatcttggaaatgaactccctaagaggatagaaaataagtcgttcaagctcttctctaactcaagtataagcaccctataactggaattatgtcttttacctcctgcttattcccagggctgaggggaccattcgtagctgataatatcagttacaatcatgcaggatcatccaggaataaaaacattggaggaaggcagcatgaaagggaaagaaaatcctggttttcagaaaataacatggagacctcatgagctcactctgagtaatcacccttcagcagtagcatctccctatccagtctgctccgtttaagggaagagttcatctcaccacagtgtttcattgaagagctggtttttaattggccctgtaccacttaatttattttcatttgcattccaatgctgtctgccttgtactgctttacttcaaagctggatctaaaaaacataggctcttagaaggttgcaaacctgcaattgtacagaggctctgagaagcgaaatgatttgcccagtgaaatggggtagtgtggaaactgagagagctctgaagtctaacacccctggcttcacaattctacctccaccatttactggttgtatgaactcaagcaaattgattcacctgtcagacctcagtttcctcctctgtaagatggaactagcagcatcgaccttgtggggtcattgtgcgaatcgccatactgtgttagtctagcattgctagtcacttactaggcactcgcgaagtgtagctgactcctagtgttgttgctcttagaaaacacccatatgttagaaaaaaaaaatagaacactttttctgcctctgaataagtgcctaagatcctctaccacttcttgctatgaccacccacccagagtaaggaagacagctgctcccccagcctcagcaatgcggagacggtgtccaattctccactgacaccctagttttttctgtacggtgcatgggaaaatgtataataaaaagcaaagtgcgtcacaaatgataggtagtcctcacgttattagtagtaatagttgctatattgagtgctgtgggtccaggcagattggtttatagtcactgagatatgttgatctaataataatgagaatgaatagataaaggggtacaagctgtcagctgacaataatgtctgaataacatcagtttggtttgcttacgtaatgggtcttacatgaagaggagacactcggaactcaacacctgaactcctcccgcttccggcaaggagagaggcagaaggcgcccacgtggtggacagcagcccatgtagaggggccacagaaaagggtgatgggcatcctctctgcacagggcagagctgcagggtgttgggagtcggcttgctcctctccacctcctcccttctgccatgttcccacctgtctcagtcagtctgcagtaacagctatagaatgtcttcatttggaacttggagaatttgcacaaagggaagcagactggacaaagagctcagatcgggggtctccgggtctgggcacagccgttacccttcccctcccatcctccgttctctcctgccgccacccacactgtgctcctggtgagctagagccagagcgaagtggaacccagagcactgtttgccaacacccgcggcactagacaacgccaagagaatggcttagtaataatgagataataacttaatgaaaaacccctgcgagccctgcggggcggggagggagacctggtgtgtggtgctggacgcttcctgagcacctccctgcacagcctgcctctggagtttctcgcgcatggcggtaagcagggccaggcctcactctttccccttcacagtggagggtgtgagcagggcttcgatgccttttgctcacggtgtccagcagtggatgcgctggttggaacggacgtgcctataaccatgactcccaccgaggccttgtcctgcaagcccagttcccatcaacagctcattctagggagggtggaggcccagtaccgcaggcttgctgcatttgggtatttccaggtggctcaagtcaaacttaagagcgcgacccattcggaaaatcaagtgaataaagcaggatggcatggaaagggatgggggctttactgagagagggtgagggaggataggacgggacaggagagagagggatggaggctttactgagagagggtgagggagcataggatgggaaagagagggatggaggctttactgagagagggtgagagagcataggaccggaaagagaaggatggcggctttactgagagagggtgagggagcataggacaggagggagagggatggcggctttactgagagagggtgagggagcataggacaggagggagagggatggaggctttactgagagagggtgagggagcataggacaggagggagagggatggcggctttactgagagagtgtgagggagcataggatgggagagagagggatggaggctttactgagagagggtgagagcataggacgagagagagagggatggaggctttactgagagagggtgagggagcataggacaggagggagagggatggcggctttactgagagagggtgagagagcataggacgggagagagagggatggaggctttactgagagagggtgagagagcataggacgggagagagagggatggaggctttactgagagatggtcagggagcataggacgggagagagagggatggaggctttactgtgagagtgtgaggaagcataggacgggaaagagagggatggggcattactgagagaggatgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacgggaaagagagggatggggcattactgagagagggtgagagagcataggatgggaaagagagggatggaggctttactgagcgagggtgagagagcataggacgggaaagagagggatggaggctttactgagagagggtgagagagcataggacgggaaagagagggatggaggctttactgtgagagtgtgaggaagcataggacggaaaataccagagtgcaatagagaaggtgcaaaggagagctgcttcccacacccttgctcctggcctgtgtgtgtccgtgatgctgggtcatggtcaaaaacacggatggccgctgacatgggtctttacagagaaaggctccatccaatctgaaaggcctgcagcaggcagaacctatccgtagatgaacaccctcgctctccagaagacaagaagcgggagtcgcagcctattgaagtgtagacatgatgtctacacagccaccctgtgtcctgcaagagcccaggctcagagcgtgtgcaccgtgagggccgcctgtgccggagcaggccgcttctccgtagcaaccacatcccacagtgtggaggttcccagcggcgggtagtgcggaaaacagggaaggcaggaaagaaacttagccaggcactgagtgcgtgggaaggcaaaacactcttttctcctcccacggcgggggcgctccctgggcgatgctcacggagagtgggagggcgtcccgcaccgggcagagctgaagggtggcgggggtcggcttcctcctctctgcctcttcccttccgccacgcttcctacccacaccagccagtctccagtaacagatatagaatgccttcatttggaacacggagagacaagcgtgccgtgtgggaaggagagaagccgctgctggagcaagcgtggtcccagaggagagcctgatttgagttaaagcgagagggcaggagaagcagttgggaatcgaggcagtgggccgaggatggcccaggttcaagaggcacagtgggaggctgcaggtgtaaggagaaggacggctcaggtgagggctgcacaggcgctgaggggatggggctctgggtggtgacatctccaaggcaagagagcacgtagatttcagagcaaaactatctgggtcagaatcccggatccaccctttatcactataaaatgttgggcaagtactcacagtgcctctgctctctcatgtataaaatgtgaggaaccatagcaccaaaatcatggaggtgttaggcagatggatgtgctgggaggaaacctgtttactagggggctgggttggagatggggagcttcttatgatgtctgctgtcagcagctttaaaggagatgtgggtgtctatcctggtggtctccctatcagcctgggatcaggtggtgagtggcttcacctactaagcccaaagatgtgttaggaaaacaggccgatatctatcgataaggaaaactggccggcacgatggctcatgcctgtaatcccagcactttgggagaccaaggcgggccgatcacctgaggtcaggagttcgagaccagcctggccaacatggcaaaaccctgtctctcctaaaaatacaaaaaaaaaaaaaaattagtcgggcgtggtggtgggtgtctgttgtccccactactctagaggctgaggtggaagaatcgcttgaacccaggaggtggaggttgcaatgagctgagatcgtgccactgcactccagcctgggtgacagagtgagactctgtctcaaaaaaaaaaaaaaaaaagaaaatgaaactcaaagggtcatgtcatctccgtcatctcctaagtgctgcaccactaaccaggcagataggacagacacatgtccagaacatcgacgcgggcccatgtgcttccctagagcagcgcccccgaggcagggacggataggacttccacagcatcatcgtcctctgagagggaagaagcaacgtgggagggctgcatggccggtggggggtccctctgggatgtgcatgatgctgggggaggggaaggaggagctggagacagggcaagtcctggtagcagtgtcaccctaaaaagggatcctgatccagatgccaagagagggttcttgggtcttgtgcaggaaggagttcaaggtgagtctcagagtacaatgagaagacagagtttattgaaagttgctcagttacagagcagggcgtccttggaaagcaaagggaggaatgcgccatctttgtttttctcatataggggccttgtctatgtaaagactgaactaagctgtgtctgcttgggtgggggagccgacagcatgacaaaatgtatattattctattgttttaaagaaaaggatccttaacatttcagtgtgtaagtacatcaaagcataactataattatctccaaagtgataatgttaccagtactggacatcaaggctttctgttgttggaggagtttttgtccttgcaggcatcaccaagttgcttccttagctgtaaacatcttaggaccatgggctgtgactggcaaggagcgggccttgctagtttcaagatagagttggttttaaaaagatgttgccctggctctcctgggctcttgcttccctgacagcaggagtctcttctgcattttgtatactgcagctatctagaatctgcacactggaagaacgtaagtgtacaggaaccaggaagcttggagaggctgctggcctcctggtcttcctgtaggtactaaggaggcctcacccttctgggatccagggtctctccctcaaggcttgggttagggacattaacatctaaggaacactatccaccgcaggaggctgtagctctgacgtgcccaagaggaaagccctgacctacagtggcggccgctctgttctaggatgtggatggcacagactggtcagagagagccagaaggttctgggggtgagctgcagctgttggcccaggggtaaatgttgggttctacccagtgccatgttaagaccaagggaaagacatggtggacgggtgtggctctagtgaacgggatttccaccttagattctgttccccttgagccatttattgagcacctgctgtgtgccatgccctgtgcggggctgtttgtcctcctgctggggttgtgtttcttgggggacatagctctggccgcagagggattaatcatgcctgaaggacctgggaggcctccaggaagtgtggccactggacacagtctaattcccttctcttccgagaccttcacgcttgcctcctgcggtcctgcccaggctacaaagttgacattgtctcctaaacagtttctttggtgctaaattgtcaggttgcaaaagctatgagggaataaacgggtggtgcatggagctggtgtcactcattgatcaacgtgctattatacgctggggtacaaagggtgcccggtgacccttccgaatctattatttactcgaaagcagtgaccacatccacacacccagggtgacacagggtgtgtgacgaggcccacagatacatgccgatttgcaggggcacctgcactgggtctggggagccatcatcctccacaggagacagcgaccacctgtggatttttgaaagaaaggagtggcatggatttccccgagcgccacctctcattcctcctctcccattcatggtcacagcctgtgtttgagagaaggctgtccagctggggccatctgggtgtggggcaggatgaagctcacgtgccagtgtggaatcgacaccctcattctctttagtatcatgcagtccccacagcgacttctgcttcaggctagttccgtaacccgggaaattttgaggatggaaaagggcagggacaggagcggtcaggagtggctcagccctgagcccagggttttgcccagccgccttccgtctaggctgtccctccatccgcatccaagaagcggcatgcggacatctgtgactgtggaggatgcccatgcccctgtggggacaggaatccctctcctctacacagaggccctgagctgcttcctggggtcaggacacacctgcacaagttgaaaggccggctcttgttctttgaacaatagaaccaggaataattaatcatcggatatagttgggcagagaaactgcttataatttacaattaattaaccttccccttaaaaaaaaaactggagacctaatttcctgtctgatccacattgtttttgatatccattatttttcaatgtgtttttgttgagattaggaaatatttgtgcagaatatctcagtccgattaaggtgacaattgctcaggattttcgttgaaactgtgtattataatgaggctttctgcagcgcatcataaaaggaaaaattctttccatcatttaatttaaaactaaagccagactatgtaaaaaatattacatgtaattttaaggctataactttgttttgtggcgaaaaaattctaactttcagatgaggacaaaataaggtcagcattttttaaaacccttggaaaatccaaactctggtaaatctcagctggtagttaagtcactgtctaattaggattctaatttcacaatctcaattatttttaactttctggtgaatattaacagaatgatcagttttggcaaaatactaggaagaaaaatgtaaactaaggaaattaaaaatgatgatagggttcacaatccatattacctaaaacactcaaccagtcactgtatagatgagtaataacaaagtcagtctcagtataattgtgaacattccttttgaaattgaacatgtgaagacacatgcacacgtatgtttattgcagcactatttacaatagcaaagactcggaaccaacccaaatgctcatcaatgatagactggatacaggaaatgtggcacatatacaccatggaatactatgcagccataaaaaagaatgagttcatgtcctttgcagggacatggatgaagctggaaaccatcatcctcagcaaacaaacacaggaacagaaaaccaaacactgcatattctcactcgtaagtgggagttgaacaatgagaacacatggacccagggaggggaacatcatacactagggcctgtctgtgggtgggcggaaagaagagggagagcattaggacaaatacctaatgcatgcagggcttaaaacctagatgacgggttgatagatgcagcaaaccaccacggcacatgtatacctatgtaacaaacctgcacgttctgcacatgtatcccagaacttaaagtaaaataaattaaaaaaaaaaaaaaaagaaactgaacacatgtcaggagctgaatttaaaacaatgttttggtcagtaccaggacacgaatgacaggctgcctgcctgtccgaccctgggccttatagacagtgtcacttgataggatgttttgagacccggacatccccagcagcccagcatgcacaggctcagagcccacaggtgcacactggggttgtcatgggagacaggtgaggagactggagacaggcaggtgcagaaatgtctctgtcagtatttcccatgggttatctctcacttactagctgtgtgagcttcggcacattatttaaactttttttcccttagttcccttaagggaaaaaataaagataataatagtgtctacctggagtgattgcgttgaggattaaatgagttaacccatctacgcagttagagccggcttggcgtgtgctgggtgctcaccgactgctgggtgtggccatcaccatcaccacccttctaagaggacttacccggaagctgccaagtcttactggaattcaataagaaaacttacttccaaaaataaaaataaaagccacacacacattttccctgtaaatcttgataggaagaaggaaaaggtcaggatgttgccgagcccttgggttggaagaggtcggagtggggcgcgtcccaggtcgggaatgttaggacaaggtggcctctgtcttcatcgtgtgtcttgggtcccccttcgtaatgatactgtcctcaccacgtctttttattatgaaaaggaagagtggcgaggacttgagtgggactgttgggttgttgtgttgcagaggaaatatgctttttgcagagggcttagaaaacgtgcagtgaaaaaaacaatgagccttcttggccccaaggcctgtggctgctggcaggacagcggtcatctgctccaaccccctagggaagagtgagccgtttgctctttttctcttctccaacttcccagaacaatgagggtgatgaatgaagaggtttcccatgatagtgaggtaactctgtcagtagaagccctgagatgtccagaggcctgggctcaccaggccccaggtcagaaggctcggcagcgccccacacttggctttcggatcatctcgtgctgggctcatcttcccttgcggcttcctctgctccctcagttgggcccctgcctatacgtctccaggcccccgaggctggcatgcagccccatggtcataatcaatgttttatgacacctgcagactacaggcaatagtagacgattttacggataatagttaatagagctctcacatcgacaacccaatgagggcagcctgcttctatccctgtttacagaggaggaaactgaggcacccaggggctgggtcacttgcccatggtcacagctggtagggggcagggccggatttcagcctcgaaagtctagctcctgaggccatgctgctgcctgccacccatcccacctccttaaggtgctgtgttcccaccacttcctaatcctcaatctcctctcccctccccatccaggaagcctgctaggatggtccttgtccatattctccttcctggcctccacctgatgatagcttgttgtgatacttgattcagctcgcgagatattcctagaacaacgagagaaaaatgaaggcgcattaggcccgccacaatcaaagctgtcgttcccttctccatccctcacggcccccgaggaacaggccagcccctttccacccgtcacatcccctgaagaacaggccagccccttctccatcctttatatctgctgaggaacaagccagccccttctccatccctcacggcccctgaggaacaggccagccccttcttcatctttcacggcccctgaggaacaggccagcctctttccatccctcacggcccctgaagaactggccagccctttctccatccctcaggtctcctgaggaacaggccagccccttctccatccctcacgtaccctgaggaacttgccagccccttctccatccctcacgttccctgaggaactgggcagccccttctccatccctcacatcccctgaggaactgggcagccccttctccatccctcacatcctctgaggaactggccagcctcttctcctttccaatgggtgtgcaggtccctccctgcgaggccctgcaagtgtctgcaaatgcaccagctgatgcccactgcccagtgggtgttcagtgcactgaaaagttccctctcctcccccactgcagccctcctgcctcacttggagacaatgcagaaccaagatgggatcaatagtcattgatttctcttggtcttgaatgatttttacacaagtcattttgcaataagagggccttcgtacggtgcctgtctgcactgagggcgtgggatgacagccatttttgctcagatttctgcttcctgatccacggtaagatgtttcctccctagctggggagatcctcatggctgaagacagtgtcctggcctcttatctatcctctggagagtctgcctcacagcactggcatagtcgtggtgagcgcaggcactaggatggaaaatctccggcacacgggaggggcacgttcaacaagagttcaggataatccctgttaccacaggggtgttcaggccttcacaggttggcagagggcccaagtgtcatctgctggtcacctcagctctgtgaggaagaaggggtgcagaccaggaagtggctcagggaggtcggaggccagcccaaggagggggtgcctgagtggccccaaccaagtgccgcgctctcccccccgccctctccccgccgccctctcccgccacgcacggcctcctggcagctctgccttttgggcacacgcaccttccgtcttcactgaatccactcccccttcaggtgggcaaacactgcctcttgcagacatgttcttgcctgtgccctgtcctgggaactgtagttggcagttactttgaagagcttaggaaacagcatggagttctgtcaggtggcagacattctagaatctctctaacaaggctgagtcggtgtgtcagtcagggccgggaaacaggccgtggagctgcctcagaaggcccgcaagttcatggccacacctggttctgtgtaggaccacatgccttgtatgtcccattacattgaaatcttttcagactgtgatgaaggaaatacagattttttttttttttttgagacagagtctcgctctgttgcccaggctggagtgcagtggctcaatctcgactcactgaaatcttcacctcccaggttcaagcgattctcctgcctcagcctcctgagtagctgggattacaggcatgcaccgccacgtccagctaatttttgtatttttagtagagacggggtttcaccatgttgaccaggctggtctcaaactcctgaccttaagtgatctgctctcctcagcctcccaaagtgctgagattacaggtgtgagccactgcacctggccaaaatacagattattttaaaaaagacattgaatgtttagaactgaattaaactgataactgcaggtttttgtttgtttgtttgtttgttttgttttgtttgtaagaagggatgcttatattcacagagtttgaaaaacaagtgacctaagccaacccctcattttacagtagaagaaaggcagcccagagaggtgggaccagagctggagcctgggtcccaccgcctgtttgcgtccttcccgtgagagcacgcagcctctataagcagcaggtgggacccaggcgtttgtctatggattttcctctcaaagttgctcttctctttactagggcagatcccaattttgaggggcctagagtctatgaaatttgggggatcctctttagaaaaaggacagaagattgtgaatggaagcaaaggcccatgaaggggagaagctctgagacccagcttctccagccccctggtgcgaattcacccctcgccaccaccccgcagggatgctcccattccacagcaatttcccgcagactctccagaagtgtgcactccggctcactgcttccccagtcttcacatgtttgcttgtcacttgattatcctccccgaagaggagccacttgtactttaaatgcctccttcacatcagcaggcaattaacagtagggaagggagaaggagggtgagcagtgaggcttctcaatcacacaactcaagagcacggggacgttctcccaggagcagcctgtctcttgtgcctaaagcacaaggggcagcggcaataggacggaaggggaccacccacgggctggactctcgaggccaggcagaggccactgtgcggtctttccttccgcttccctctccctgagccttatgcaaatccggctcttagcacagcctttagctcttgtctgaattccaggggaggcccaagatgggaccccctacttcaaaaataagcttgaattcaaacctccagcattgttccacagtgcgcaggccagaagacatccattctgttcctccaattccctgtaaggcccctctctgtgtccagccagatagcgtgtctccaatccatggggttgcagaaggggctcgctgcctgtgcactagatgccaatacggtgacaccaggattttcagaaaagaaaagctttatattaaaagtctattcccagctgggcgtggtggctcatggccttgggaggccaaggagggcggatcacgaggtcaggagttcaagaccatccaggccaatatggtgaaaccccatctctactaaaaatataaaaaattagctgggcatggtggtgcacacctgtagtcccagctactcgggaggccgaggcagaagaatcacttgaacccagcaggcagaggttgcagtgagcagaaatcatgccattgcactccagcctaggtgacagagcgagattctgtctcaaaacaaaaaaaagtctattcccaaggagacaggcatccagctcaactctgcctccctgtgctggcttcaaggcagtaattttatttttaaaggaaaaggattcagcaggcggattctgggattagcaggtgattggtggaaggaacggggaggtttggaaagtccttcagcacacacaattatttcttcacgattactcatgggctgtgtgtgcaaattcaggggggtggggtggaggaaattcagtccatgacatcagcaagctcattctgcacagaccccagttgaccaacttggttctgacagacttcagccagttctcttatctcggggcggagggagcgtcagtgtttcagcaggttgtttctattcttgtctgccattctgcgagctcaagaacttctgttagccattcgtttctttaactctttgaggcattgtttcattattaggatgcttgcttatttcttgtctcttgagcaactgagtgggtggatgacccagtcgattaacaaatgagtgagaaacgagaacatccttgccacactgggacctgtttgagcgtgaggcaggtgagcagaagacatcaggcccagaagttctggaagctccctcaggtgcccacaacacaaatgaagaggaaagagagaagacaaaacaaaaagaagggtaaaggagcctggcatactggctcagccttcctctttcaaaacttttgtttttttttttttgagacagtcttgctgtgtcgcccaggcttgagtgcaatggtgcaatctcgactcactgcaacctccgcttccctggttcaagcgattctcctgcctcagcctcccggatagctgggactacaggcgcctgccaccatgcccggctaatttttgtatttttagtagagacagggtttcaccatgttgaccaggctggtctcaaactcttgaccttaagtgatccacccaccttggcctcccgaagtgctgagattataggtgtgagccaccgcacccagctcaaaacttttttgaaactaaatttgagctcagcgatctaaaatacaatggcataaaactgcaagtctataaactgggcatagctctttcctcctctgctctgcaccaactggggtgaccagaagggactgaacagtctaggggcaggtcttgctcactcacgcgtccatggctgacgctggctgctagatgaggcctgctctgtgtcagccaggacaccaaatgtggcctctccatctgaccagggcttgctcaccacatagaaggtggtgttcagagtgagtgacccaagcaagagagagccaggggaaagccataccaccctgtgtgaggccgttcttgcattgcgataaagaaatccccgagactgggtaatttagaaagaaaagaggtttaattggctcccagttctgcagactgtgcaggaagcatagaggcatctgcttctggagaggcctcaggaagcttccagtcacggcagaaggccaatggggagcaggtgcatcacgtggtgggagcaggagtgagagggagtgagtaggggtgagggaggcaccacacttttttttttcaaggttttattttatttttattttttattatactttaagttctagggtttgttacataggtatacatgtgccatgttggtgtgctgcacccattaactcgtcatttacattaggtatatctcctaatgctgtcatccccttcccccaccccatgacaggccctggtgtgtgatgttccccaccctgtgtccaagtgtcctcattgttcaattcccacctatgagtgagaacatgcagtgtttggttttctgtccttgcgatagtttgctcagaatgatggtttccagcttcatccatgtcccaaacagtcagatctcatgagaagccgctcactatcatgaggacagcacggagtagatggtgctaaaccatttgtgagaaatccaaccccatgattcagtggctcccacctggccccgactctagtatcagaatgacaattcaacatgagattcagacagggacacacatctgaactataacacaccctttatgacctagtctcacaagccatcactttctgccacattctcttcattcaaaacactgccctggttcaaggagcaaagaatcacctcttctttggggagtctcacgccctggaagtagcactgaggctagttttggaaaatacagtgtgccacactcaccaaggcgtcagtctctgtgaagtaaattatactgagacatcagtgacttcatagagaaagggcatgaataacccctaaccacaaataatggcaagaagtatccatggaggcatcttgggaagaggcttctgatgttccatgcctactccaggcagctgtgtgccccacggccttccgcagtagttgaattcgcagactgagcatggcattggacccgatggccttgcttccactgagcctctgcacaacactggccttgggaaagaccacaaaatagtaaccggcagggctcagtagacccggaagcttagaacctgtagaaaagagaaggcttcctgtgatcctcctgcttcaagcaagggctccgccatctctcctgcagataaaaactcaggaacattttatgttctgcttttggagggagtttataactttacattctgtcttaaagaaaacacaagttttgaattctgggataccgagttcctaaaagaaaatccaggcaacaggaggctcccaatgtgtccaacctgcctccgatggtgcaatgaaacagcaagtactaagaaaatcaccaaagtgtggaagtggcaggggactgctttaacagcaagagaaggagaaatcttagtcgtgctagttccacatcgtggctgcctttgacttctggccatttagaaatggctctgctgccagctgggtgcggtggctcacgcctgtaatcccagcactttgggaggcccaggcgggtggatcacccgaggtcaggagtttgagaccagcctggccaacatggtgaaaccccgtctctactaaaaatacagaaattagctgggtgtggtggcgggtgcctgtaatcctagctactcagaaggctgaggcaggagaatcacttgaacctgggaggcagaggttgcagtgagccgagattgtgccactgcactccagcctggatgatagatcgagactccatctcaaaaaaaggaaggaaggaaggaaggagagagagagagagagagagaaagaaagaaagggaaagggagaaaagaaaggaaagaaagaaaagaaaaatggcttgctgccgagggaagagagagagatgaaataaatatgtctcctcaccctcttcctacccctgagctaggcacagttcgcttgtccatatgatgagatatagatgcgagggtttagctgtggattccacagcctccatcagcagcctgcgtgctcctaataaaaatgcatcctagcctcccaccttggcctttcctcacccagaaaaacaaggccagtgaggtcctaaagagcctattctgcaggagcgcatgtgagaagaactcttagagaaacagcagcaagttcaatttccccagagaaccctaaagcctcctatttcccttcagcctcacgtctgtgctccctaagctggctttggatttctctttagctggacttcattggcaggtgcggcaggagggtgtggggagccccctagatacaactgccaaggagactttaagtctgcctcactcccggcctccctttttgtactttctagaactcctcttggtgccctctctacccacacccctgtgccctttctgctgtgcactcaccttgcacagacctgtggatttggatgccccacctccatctgcaccacacctgagctctgtgggcgctcttcacctctatgccctgggcactgcatcttaggccttggatgtcatttggaagcagagtctctcttccttgttaaagcattgctgggatacagaggggagagctgtcctttcccgggcttgggtcctttgtagaagctaaaatggcacctgttgggcagctctgtcttcatcttgtgaatggaattgaccactctcgctcggtggatttgctagaggagcttcatctgatgttatactaaggacctcaagaattcaccttattcttgacctgttaggtccatgaaagtgttactgtaacctgcgtggccaatgagatctccactccagccagcaagaagtgggaaagagaggcggtggtcataccctttctccttaaaggcggaagacaggtgtcactcatcaccttttctcaacccagcagcaggaactcagcacacacccaacctcacatctggggagtctgggaaaggtctttatcctgggaggccgtgtgcccacctacaagccattggttcttttactaaaaagagaagggagtgtgggtgttggaggacaatgagcaggttctgccattccaccttccacaagaggcttctctaatttcctccaataagaaagaggcctctctgtattcccagaccccatagttctttctggtttctaccttgcccactttccccgagttgcaagttgcagttctccttctgtttactgtattacaaacttccaagctttgtctctactttactataccctagggaattgtgtgtactgagtactcagtctttgttcaataaggttaatttccctgaacctccaattcctcagttgtaaaggggcacttaatataagcttgtaggtgcatcacattctctccagagagagaactcactcctaagaaagcagcaccaaaccattcatgagagatccacccccataacccagacacctcccactagtccccacctcccaacacctccacattgggaattagatttcaacatgagctttagtggggacaaacaaaccacttccaaaccacagcacacatatgaatgagatcattcggcattcgtctttctgtttctggtttatttcacttagcacaagtcctccaggtttatctactatgttgcaaatgccaggatttcctctcttctagctagtcattgttaaccagaatgtgcaccaaactcacctgaagaggttttgcagaaaaggagcctgtatcctcctcactgcccccaccaaataccagttctcctgcctgaagtgcagcctcagcatctgtataagcagcacacacatgcgcacaacagtccaatggagtcccctgcaaacctacctaaacctcactaggcaaataggaaataatagtggtggtcacctcttcatctgtcaaacaacctggaaaatgtgaagattcctcttcattgttgcattggcctttattaccttgagcacaaagggatttttctcctactggatatgaccttaatgctgcttggcaggaatgaataacactccagataatggcactggcttcttcaaggtatagtgacaaaaaatgaaaaatacccagcccagatcctacctggggctgaagctctggatacaacttttgccatcttcaagagagaagcagccattgaacaccgactgtccccggatgtatctttcttttctgatgctaaaatagccccccagcaggacagggaaggtgaagaaaagatgtattctctagttttcccaagttaattatacttgctcagaaagccaagtgattcattttgttccaaggcaggcgtccatgcaattaatttcgttgatgaaataggttttcttctgcaaaactctgcttctaaactgcatttggtgcatggcatttaagccaactgcctcattaagctggaatcctgcagaaaaatgtttgcagaatagggacatttggaattaatgctaaaatgtcaaggtttcttctgcccagcacttttttaccccttagtttcttatacttcattatcacattaatgagcaactaacgtacaggaaaataaaaatggcaaggagcgatgtgttcaaggacacctagggaaaataaactaaagctgccctagttttgtacggctggcattttggcgtggcacaggttcttcgcatgtgccactgtctcgatgtggaatgacattcagaggaactaccctctgccatcacacacaccagatacctgtcatccctgaacccgatgacccaatggtcgctaagttcccttcttttattttattttatttttttgagacctagtctcactctgtcacccaggctggagtacggtggcaagatctcggctcaccgcaacctcccaggttcaagtaatgattctcctgcctcagcctcccgagtagctgggattacaggtgtgcgcccagctaatttttgtatttttagtacagacagggtttcaccgtgttgaccagaatggtctcgaactcctgacctcaagtgatccacccacctcagcctcccaaagtgctgagattaaaggcgtgtctctaagtttccttctaaccgttacatttggtaacctgtagtgatggttttgttctacctcccagttctctgaagagtgaattgagcttcatggaaacactctggcatttgctgataagatcgatggaaatagagtattctcagcccagccttgtggccagccttcacccacatttttttcagtctcttgtcccaacaagcatgacccactttggactgtgctggtcagaaccaagcagcagcatttcctttaggtcagagagcgagtctagaaatgagatacaaacaaccctgggtggaaatgaggggtgacccttgcccccccttgcctagtggcctcttgtggaacctacggggtaggaatgaaagtggcctgatgttgcacgtggccgatgatttatcatccctctggtctcagaaaagattgctttgggttcaaaggaaagaaagaaatgagttgtctcttcgggggttttgttgttattgttgtttgtttgtttctgtccaaagctgcttcatttttaaagctcttgttgcagccagccgtttttctgttttggattttcccgagtcggctgtgaattaatgtcccgtggaaaccactgcagggctcctctgctgatttctgtgggctctgcaccttctcgctctgccctgtgaattctgctcactcccagggactctactccagccccattggcccctttcttgtggccctgcagcgcagacgtgattgagcacaatcacccacaaattgcattgcaaatggtgcctattttttccagcagaccatctgctggagtcaattactcaccattccaagcgagcagcctgggcagatctggtgactctgcataaagtcacttctgagtcacctcatcccaaactcgcacctgaacgtccacctcctggctgccaaagcgactggaaaattacagaccctggaggtctggcttccttcctttgtcttctcctcactgacctccacaggcctctgagcttctattggcactgccaaagcttctgaggctgtgagacagacgcagaggggaaggggatgctagaggcggctgttgtgcccctagctttgcagatcgggactcaagaacacacagcaggactggggctcaagtccagtgcaccagggctcctgaattcatttttccctgagcactgctctccatactccgggatgcaccagagtacaggaggtcaaacccgccacagggtttgtatttcaggagactctactgagatgttcaggagtctgcagcagactcggcattgccttcggtggggggctgtctgctggggagtctgaccaaggcaagatgaggaagactcacgtgacaggggagcgaggctcaatgagctgcagcatccccatcagtgccatgccagatgccacagacatctgggcagggaggggcagggcatgcaggcacatcacaccctcagccccactgcccttagagcctggctcctgctcccaccccaggaggatcatgggcagcgtgcctgctgcaggcctctgggcttggctgtgaaatgccaccatggatgacactgacctggcgctaagccccccttcatgaaccctcctcccggccagctggtctcctcctggtgcctcccgcagaacctgggaggctgttgatgtgggctgcttcttccctgtctgggactgtgccctcctgtgggcagtcagcccttggcttccttccaatttacattgttctgttgcatttgatgccctcgttttgtttttgcaatgtgttttcaggcttcttaatcacctttctacactacaggtacatagagcagatttatggtacgcacctaataatagcgagttgaatgggactcatgaattatattaatcattattttagaagcaaatctagagggaattagtttacactatatatagacccagtacaagacagaaccccttgacctaagagctgttcacaatgaaatgggttctctgactggttacccttgggaagtgtattctcccaacgtgttgaaaaaaacgctgtagaaatttcccctctagaatagatatcacaccctacaaaactcatctgtcgttaaaacactaaccaggacactgatgggctaggaaggaataatgggtgtttctggttgaagcccaaaagaatcagtctttcatttcagtccttctgaagatggatccattttggttttctgccatgcatagtgagcttgtacccttcttgtaagaagccacacagagtgagcttgcaccctttgtgtgctgcaaggagcatgctgggcctttggactcattatctgaggagggagctctgtgtgtgcgtaaatccctggtctgcttttgggcgactcagcctctgccagagttcactttctcatttggttccgtctgcatgggacacgcttccatgtgaatttactttctccagtgctgtttttcaaatcatattaagtaataatcaacaatagtacaatcatagttcaactcaaaaggacgtgttgggctcatagtgctcaaatgtgtgcaaagaaaaaaaaagtgtttccagacgattagcatctgtttgattgagctttggttaatggggttttcctgtgctggacttagtcatcagcatcagacatttcttgagcccccatggaatggaagcatgtgcagaacacagtgaaggttcctcaaaggttgtagcagataaggggctctgcagggactcgtttctttcctggccacctcatgttcctgctggtgcagctccaatttccactcacttgttactattcacatttctctactctgttttcccttagaggagattttgaagacacacatcgcacactggtggtctccggatggcacgagactcgcctacgccgccatcaatgattcccgtgtccccatcatggagctcccaacttacaccggctccatctaccccaccgtgaagccctaccactatcccaaggtaggcaaagggacaccgcacagcaaattctttatattattcatgaacaccccaaccctgctcactcagtgtgcagacgtgatcatcagacatgtgtatgagcaaagcagttaacacaagaaagactaatcatgtctcattacattgcattacattcccgcctctgttgagctgagtcattggcaggtttacttcttttaggtaaccgaactaatgttcatcacctgactcagcttcactgaaccaaaacacacagggtacctcccctcaccactccccagtgatgaaggtgcacctgccctctctcacgcatcttatttctactttgagtttggcctctgggaaggcagaaagacttccatctgcccctggtcccctgggtctgggcaaggctgttttgttcatggtcactgctacgggctaaatgtttgtgtccttgccaaattcatacattaaaatcctaacccccaaggtgatggtattaggagggagatcactgggaggtgacaagacatggagggcagagccttcatgattgggattagtgcccttatgtatttgtctattttcatgctgctgattaagacatacccaagactcagcaattgagaaaagaaagatttattggacttacagttccacgtggctggggaggcctcacgatcatgtcagaaggtgaaaggcacgtcttacatggcggcagacaagaggagagagtttgtgccgggaaactcacctttttaaaaccatcagatcttgtgagacttattcactatcaggagaacagcatgggaaagacctgctcccatgattcaattacctcccaccaggtccctccctcatcttgggaattcaagatgagatttgggtggggacacagtcaaaccatatcaccttataaaagagaccccagagagacccctctctgattccaccatgtgaccatacagcaagaaagcgtcctctgtgaaccagaaattgggccctcgccagatactgaatcagccagcaccttgatcttggacttccagtccccagagctgtgagagatacattgctattgtttgtgagccagtcagtttatggtgttttgttacagcagcctagaggggccaagacagtcatgttctgacccaatgagccagtagaacagcaagtgtccagtggctgggagggaatattggggggaacagggatatccaaatctcactttattaccaaatcaaagcatcccagtgtgagtggagggcctgatactaaaacctccacagccactcagctggagagaagccagtgcccgagtatggacacagctcccatggacacatagagtctgccatgctggcttctggcttcactaggcttctccaagacccctgggcttggtggaggtgagcagtttcctgcctgcaccctgcctggtgactggaggctcacttcctgccatgagctgcctctgccagggggcatttaaacctcagcatcctagcccaccagagagctctgaaagctgatggtatgtgcctgctctgccataatcatccccacagaccagctggcttacagtttgcagcaagaggagtgataacttataaggcagatatatgaggccagtgaggttcccagagtcacagcctagagaaaggaaacacctggtgtcttagtcagttccagctgccacaatgaaataacacagacctaggcagcttaaacagcaggaatttctttctcacagttttggcagctggaagtccaagattagggttccggctgatttggttcctggtgagggctctcttcctggcttgcagacagccgccttctcgccatgtcttcacatgaaggggcaagagagggctctggtgtctcttcctctccttttgtggacatggatctcatcacaagggtgccaccctcatgaccttgtctaacctcaatcacctcccaaaggtcttacttccaaatagcatcacactgggggttagggctgcaccgtatgaattgaggaacttgttccatccatacacctggtaatacaggctcctttcaacagcctttgatcagcatggccaacatctaagagagccccagaaggaagaagaatgagacccttatggccacagccttcctttctgccttttccaattctgagagcatctggatgttaacatggcatggatttgccttcgacagaattatttcactcctttttcagctaaccttgattggtcttagtctgtagcatgtggaagggtccagcattttagttggaagcataattaaatagagaaaagtgtatgggactgatgctagttccttctaacccttctacatttcttaccagctgttcacagccaccccacccgccagaagagctggtggctgtctgaccttcatccaacccagagatgaatggttcccatggttatctttttgtgggagtttccccagtctaggagtgataacctggaatccagtagggtgcccttgattttacagtgaactctcagaaggtgctctgaagctgggattatgaaatcccagattactcaagatttggggtttcatattttaatagaaaaccaacattctggctgacagaattcagatgctccttgccccattcccacccactcctaaatcagaggcatgaataggcaagcctgcctgacatgccctgtcgtgggcctgatagcctctgtaaacctgaacatcttctgcagggtggaagtgagaacatcagacaacaccccgaagtccccctaaagaggaagccccacatctctccccagacccatacttgtcccccagagagtggggaacagggaagcagaatagtgccccagttcctttttgaaggacttaatctctccccatgctgagcatggccaccgctcctcaatgtccatcatttgctcacctccaactctccccttcctggcatccaatccatcttttctcccccactcctcttctcgtcttctcttttaagcaaggggctcagtactcacttgacattgccaaaccggggagttgggtggaatgggaagcggatgggattctagaaaagcaagaatcagcccacttagccctttgtccttttgaaaccctacacatgaaccatttgttctccacattaattctgctccttaatatggagctccagtgtcctggagtcccacctcggaatctcccaggaaaggctttgcagagctgaagttcactcttgtataaggctgcttgttcatgtctctgcccctttttaatccccaggctggaagtgagaaccccagcatttccctacacgttattggcttaaatggacccacccatgatctggagatgatgccgcctgatgatccacggatgaggtttgcttccttctattatgttaccaaaaaaaaaaaaaaactaagatgaatgttcaatgtgcatggtctcttctggatcagatttatcttacaacaagtttaaacatccaagaaaaaggtacctttcctaaagatttcctcactgctttatgattccattttctaggaaaagaataccattcaccaagtactattattttttaccttaggtcagatgcaggttatcctcctgagagctgggctcctctgggaggggcatggctgggccccaggcctgcctcagggggacaccagaggaaatgatgcggtcttcccaagacaatccatggagtctgaccttccataaatggtgctctgtatttagagcattttttagagcatggagcaatttgccagtggcaaattctattctaataaagccacatctcccagttggtaaggtcgcaaccctgtggaaggtattaacaatgttattgagttattattattagcatctgattgtggtcgcttttttctaaatcaaaacaactgatttaggatcgaatgtagtgatctgaatatcagtttagtattttccccaaattcaagcagcgtggggaatgattatacttccagagtccagctataacatcatcagccttctctctgttaaggatattgatgagagactcaaaaagaggaggggattttaggggtgccaggacccacccaagtatagattctgaaatttcatgaatggcactatttaaactaagaataactcattctgaggctcagcaaagacccaacccatattttgctatacctccagcctgggcctttattattccattcaaagctccatattactagtagcttctggcagcttctggaaagggcaggaatcgaggcctcaggtctagctcggggatggatgctccagcacctggtgactctggacctctctgaatgatgtgctggtctcctgcagtggctccagtgccacctttgccccacaccctgagctcctgcacagaagcccgaggcctctgcagaattctactgcgattccttcccctcatctttcttcagtgaaacttataatgttgtaagatccccaagtggatggatgaagcccagaagcccagtgctctaggaagcgtgaggcactgcctgcccctctcagccctgcatgggtcttctccccaacataggagggcctgtggctctagaggtttaatgaacctggcccccagcagctggtcccagggacaactggtcactggggtatcagcccaaggtgtgcgctggtttggagagttgaattgatttggctggtgatatttttgctgagatttaaaaaaaaaagttcagatgattgctttggcttttctcctaaagttccatatattttattgttttcctttcagcccccatccctgccaagcctcctggggcctggtccagcaaactcactgaattaatatggaaagtcacctggaaaatttcagccatctgtttgagttaattgaaaatctcgtttagtcaatttggtgatgctgtttccacaggcttgattagcttcaaggacaatgaaaaattagcgtcagccaggacttgaagcctggatgctgggcttcaggttttctggttgctctcatttcctaagctcaatgcaataatgcattttatatgcaatgtaaatttgtagcatgtaaatgtcacactttctcatactgcttctctatcacacatctttgagagtttttaaaagtccacacagatatatcagaaatcccaggctcaatgtagagcagatgtttagtatttgccagccatttgcctgagcactgggaatttggtggcaaatgaaccatggagttcacagtgtggaggggaacctggatcctgaagaagtcattactagcaagtaaatccctgcaggtgtgagaagggctgtggaaacgtgtggaagaggaggccacctggtctggagggtggcagtgtcacggctgaggtcagagtttctgcatgtccatgctactgacatttggggctcagcaattcagtgctgtagggggcagtcctgtgtgccgtagagcactaggcagcatccctggccttacacattagatgctgtcatatctgccttttccccctccagttgtgaccatcacaaatgtctccagcattgcccagtgtccccagattgaggactactggtttcaagtgaaggttctctagccaactgcctgggttcgagttctggctctgtggactctgtcaagttactcagcctccctgcttcagtttcctcatctgtaaaatggagataattttaataagaaacatgtttactctcgtggacagttgtgaaagttagatgagataaggcaaggatcatagggctggttcctccaatcgttccatcttgtggctatacataccccttgtatgtggacaactctcccctgtgtacctcaacctggcctgggtcaggactctaggttcaaaaagccaaccacccaaccagcatttctactgggagtggtcaccatataatttttaaatggtcaaattgtgattctcagacaaaatcaatcaacatgtgtccaagactttattaaactcattaattaataagggaaccagtgagctcttaaaaagaggccatagaaccatcgagaagctagttgtatagaggcaattgaacaaggacatcctagggtgagtctgccgggttactcagccatccgggagagacgcctaccccagcagggttgagaccgcccctgcaattggaaatcaagcccagcatgtccctggagaagggcccagtgatcccacctgcctctttaccaccttcagatccatttgctgacactgtctacacagcatctcaggccgaacccggtcaaagccaacctcccactctccttgtctacacctgctccctgcagtctccccatcatggtccagggcaactccaccttccaggatccccggcctcctttacgtccctctgtgctggggaccctccttggcaggtgcctggcatcagcctgcaaccccccgccgttccccactcctccctggcctggcccaccagcactgccccctcctgccccacccactgctgaccccacacagcagccagagtaaccctttaaatgacatcaggccacgtacccgctgctcccagacatctagtggcttctatttctctccaagtaaaggccagacttcctacagtggcctcagaagcccccatgatagatgatagatagatagatagatagatagatagatagataaacagatacatagatagatagatagatgattgatagacagatagatagataggccatgcaccctttctatcccccctcacatcggctgggtcactcccatacgaggatctgcacagaggctcccctctgcccagagagctcctccccacttaggtcctgatcaaatatatggttcccacagtgacttccctgataaccacatttcacatggcagccccaccccgcttccattttcttccttcaattcatcccagtggaatttttagatacttttttaaattgtttcattttcattttcccgcctgccacctagaacaggaagttgttgaggcagggacgttagttcctgtggggcgggccctggctccagttctgcagcagggctctggaaccttggctggatggatgtattgacttcaaatttagccggtaaaatcttatttgcatgggattcttgaagcttgagatatcttcagttgtgctggtacctttctaagaaccaaaacttacttgctatttagccatggatgacatcttgtcctctcaagcacaagatgctaaaggaactaactgaaactaagacacctcgtctgtggagggacacaaaaggaatgaaccctaagccatgcccctgagcacctaggaagggagacatgcagaggtttctggaagcctgcagtttatttcagcaggctagctcacgaaccaagaggaagggagaaagcagttcatgtatctgctatctaacctttatgccactcattttcaattattttttcctgtttgtttgcttgttaactagattgacttctccgatggttctcagatgcagggagagttaagtctgctctttcaaatctttgcattggcaagcacttactcatcatccatgtggcatgtgctgtgtgaggcccttgggtgattaagacgtgtggcctctcctaatgagagctcacattccaagaggcctggacagcttgtagccagagtctgcatggaagtgtggaaggagccacacctaggagcagaggtgccccttgtggggtgagtgggaagtgttcaggatggttttgcagatgtcagaaggatcccggggcaaaattggaggccctcttgggaaacggttctattaaagagaactaagagcggtgggcccagagtagagctcagccttccttgggctaatgcagggacccaggccttgttaagctgaacctgaccaggaaagaataaacactgtctatcctgtgggtggaaaaaaataaatgcaaatcgctgtgctgtggtttctatgctttcacacagaaacccagctgcactgataaaacaaatgcgcttgttttctgctggtttcctccggcctttcccgagcagttgagctgcgtgttgagttaagatgcggcagatagccagcacgatcattctgaagacatgttgccctgtgctgatatgtgctgttatttgcctccaaagatcctgtttggatgcagcgcagctgctcttctcctgattccctggcaagcagaggcggtaaagggctcccagaacccaagacacaaaaccaaccatgtccctgatgcacctgtgcgcagctgtgggggctcactcctccaccacccgcttccacggctcacgaaaggctcagaggcctctcactttcattttcttttgcttccatttatttgttttgatcccaagcaccaaggatttagatgctgtgcagctcctggcacagaagcatggtcggtccatgcaggcctctctcattttattgatttgctctttttcaactttagtccctactcccatgccctcgccacctcataggcacttatgtcgaatgcttagaggacctttgttcctctgtgtttttgtaaagcctgtattgttgcttgggtatgtgcgcgcttactttacatcaatggcattgtgatagagagccagataagctacaggatagaaacagatagagctccagacatagatgtctgtttctcctattttcctgtgagcaccatgtggagacctagcacacccatgtgtatttgaccaacccacggtttctaactgcacacagtgatgccagatgcccccagctcctgggcagcttacaacctcatggccttctctgcctccaggcttctccccaatatgcactgcccatgacacctccatgctgaccctgatgcgaaactcagccttctctctttccaatttatacaaaacatggtatgtgcacgagttttgggaaagctgagggtcatcagggccatgaaaacagcacagaacaatagagttctcatacctaatggcttgagcacccccccccaaaaaaaaccaccaccatcatcagtaccacctcttccccaaccttcaccacctatacaacctccaccaccaccacaccaccaccaccacaacctctacaacttccaacaccaccttcaccaccagctccaccaccatcaccaccaccacctctgtcacctccacaacctctacaacttccaacaccaccttcaccaccagctccaccaccatcaccaccaccacctctgtcacctccacaacctctacaacttccaaccttcaccacctgtacaacctccaccaccaccacctccacaacctttacaacttccaacactacaaccttcaccaccatcaccaccaccacctctgtcacctacacaacctctacaacttccaccaccagctctaccatcacctccgctaccaccatcacctccatcacctccacaacctccaccaccagcaccccaccatcacctccaccaccaccaccacaactacccccaccatcaccaccatcacctccatcacctccacaacctctaccaccaccaccacccccaccatcaccaccactatcaccgctatcaccaccacccccaccatcatctccactacctctaccacatccatcacccccacaacttctaccaccaccaggtccactgtcacctccaccacctccatcatctccacaacctctgctgccaccacccctatcaccacctccaccaccacccccactactatcaccaccacccccaccatcgcctccaccaccaccaccatcatcacttctacttccaccaccaccactgtcagctctcacttggtccctgttgctctccattcttaggtctcctctgcctccttccctatcataaacaagctctcctgcctcacatttacaatgtcaataacctgtcacatttacaatgacctgacttgcctatggttgcacttttaattagtagtagaaccaggacttgagcacgagtcttccgtcaccagagctattgctcagcattgtttaagagctgtcacgcctactgtatttccctttgtgcttgaactttcaggtggcacaaagctcatttggagggtttgctggcaaaatctctgttcttcctgctttcctccctcaggctgtggtccatctggatgttggggttgttcagacatcttcaggtgattcctaagtgtggccaaggcagagaagcccttctcagcagcagcattttacaaattatagctatgcccaacccccagttccaccccatccctgagtctgccatcttacctaaacatagtcctaacctctcttttgtctgggaagatatattattttatctgaatttgtgttccaattttttttggacgtggtctggatgtaaattacaatttcacaaatgtgctctgttcccctcacctgtagtcctatctctgttttcaccttgtgtgttaaagaaatcatctggctacctaaatactcaaatggattcatcttagggggcaccagttcaaggagattggctccagcagacagctttgtttacagccttgtgctttcagaatcagaccagggcagggtctttgttattcattagggtgagaagccattcccagtgactagggtaatggagaagctccagactagagaaatgccggatctttactgatgtgctgaaaaggaaattcacaaagttcctgttgatcatgggatcattaataaaaatgttcagtgctgtaggaggctggaaatctgagtcacagctgtcagaataataagtttctggtgaagaaagtacattttacattgtcatggcctgtgtttgaaagggcagctggattgttctgaagatgctgtaaatgcagggaatgattggttggttggcaggcttataatgagcaggagacatcagaaaaataaaatgggattctgcgtcgccatcctcatcaataaaacaccttagccatatcttccagctagcaaaacagtcttgacatctgaaattgtcagtaaaacactgaaacactggacaaggtttgccaaggcagagtcactgggctggtgagccagtgctggtaaactccaagggtgtaagtgacatccgcagtttcttcccgtggaccacaagtagcaaattcagtacatggatttcatggcatctgcaggaaaatgagacttggcaaaatttacctagcatcatgtttttaaatgtgttaacatgcattgaggcatgagcaaatattgaggaaacaggttgagtccatgggtgggtaggtgggtgatgaatagatggatgggtgatggttgggtgggtggagggatggattatgaatagataaatgcatgatggatgggtaaggggatagatagatgaataggtggatagatggataatgaatggatgggtggatgaatagatggatggttgatggatgagtgaatggatggatgatgggtggatggacggatagatggatgatgaatatatggatgggtggatggatggatgatggacagttggatgaattaatggatagagggatgatggatgaatgggtggatagatgaatggatggaaaaatggttgatggatatatggatgggtgagaggaatgaacagtagatggatggatggatggatggacagactgatggacaaatagatagatgggtgctgagtgtgtgaaaatgaatggctgggaaaaggacaacatggctttacccccaccactcctattcactgggtgtcttcatgttcacagcattaaattgttgaaaaaggatgccgcagtccctaaggcgcgttctctgtgaccccctctcacttcgttctccctcatcctgacagctggccctgcattatagccagcccttgagatggaagggacaggcagcatggtctattcctacatggaaagtgaaattatggaaacagacaccaaatagtaatttgtcttaagtcgtcacttttctgtgttgtagaaggcactctgccggcagatgtttttatgcaactgcatggctgcccgagagcatactcaaatgtggaactgtacactttagtagagcagcgcttggtatttagggtcgtttcagtttgctcagcggtgccctctattaaagcacatcatcttttaaaatgtcctctctcataacatttttgtacccctgctcaatccatgggataaacattgctaaaaaaataccagagttaactgtgggccctttatttcatgagataaaccagctttgttcccctcgccctttactgccacacaactgtcagaacatttgccaggatttgcaacacaaagaagtatcacagcacattaatccttgtgacggagacaatgctctattaatattttatggcaaacaaatggactaataaaaaattgatatgcttctcaccaggaagagtcactatattctgatttgaaggcacctttggcctaggactcatggaatgtaataacgtttcctcagccaggctgtgccattgcatgtgctcccccacgtaatccatggcagtccccaccctgtgctgaagttagtggcttgcccatctctgcaccgtccgcacctagaaccgtgtctcccacatgccaagccctgactagatgcgcttggatgcatcagtgcattggtaggcagatatagtgctttagaataaagagaaatttggtagcatttcttccagctatcttcgcttcctgttcatattttggtatcatgctctttttaaaatggaattttgattattaaaatatgaccatctattttctgtgattatcaaaatgcttcaatatctctcttcatcttggcagatagattattgcgtcttttagcactcagctccagccttatgttaaaaaatgattccacttcaaatcctattttctcctctcctttaactgctaccaaatttctctttattctgaagcactttacctgcctaccaatacatttacccattcaaagaatatttagtaagggcagatttggaaatggagatctatagttaaatagcgcttggagttattctcatgtggtcgcccactgccagacagaggatcgctcgtctccaatcagtagttctccactcgagctggcactggaatcacctagggccttgttaagccaggaagtgcttgtccccacccccagagtttcagattcagagggtctagggtgaggcttgggagtttgcatttctttttcttttttattattattattttttgagacagagcctcgctctgtcgcccaggttggagtgcagtggcatgatctcggctcactgcaacctccgcctcccgggttcaagcaattctcctgcctcagccccctgaatagctgggattataggcaactgccactaggcctggctaatttttgtatatttagtagagacggggttccaccatgctggccaggctggtctcgaactcccgacctcaggtgatccacccacctcggcctcccaaagtgctgggacatgcggttcctaacaccttcccaggggctgctggtacaggaaccacactgtcagaacctgacttgcctccttagagatgggggtagaggctgtttccaccacctgctttctcccctaattgcatggactttgcctgactttgccacaaaggcctcgcatccccatagctgtcctgctctctctgggtggcctgacctccctgggcgagggtgacaacactgcctgtgattgctgcgaaatcaggacagctcacacaggacgggcagggtcttctctcgtctctgcccgtgcttccttctaggcagcagtgccttctgagtacagtcatggtggtgccaatgatgtccctgtatgacacgagatgtgtcacccatgcagacaccaacaggtttacagggagcagcgcgggtcagtggcgtgtggcattattgcggctcgctgagcagtgggcagccattcccgcagcacaggattctgctctccctccacttccctttgtgaggcatggacgcctcccatcagtccaacctgttctcatgactgtgccttctgttgacgttgagtgttctggcattataacgttcctgtagagtctccctctgatcaatgcttccctttgtcccctcgagagacagtcttactcggggcatgggaatttgacaggcatctgcaggtcccacgccttgggacagaacacacatgagtagaagcacttccttctccttgctctttgtctcaaggagctccccgcctggccaacccaggactgtgaggaagaatggtaaggcctggaccttgtgagggaggaggcaggaaccagaagggctggaaaagggcacaggacaggctgacaaacatggctttcttggaggctatctcttcaagcctccaagaggagctttcttggagacagctcttctctgccctattttcatcattttctataggggcaaagacacctggggaactgcacaaggaaaggagagttttcggctccagcttgagccactgggactttcctgcttggagaaggttgctgcaaggggtcctgtgtgtttcattgcctgtgagcctcatgcccaacatggaacctcctgcatggcgtgaacagtgcacatccaagcttcgacagcagcctctggggagggaattgagctacaacttgcactgtgaacacgccattctcctgggacaagaggccctcataaggagagagacctaggacaagagtgagccagacctcggccccagctgtgcggacacttgcctgaggaaaaccttaccaagcccccacccttctgtaaaattcagaagtcacagaagcttatccaagcaaagcccgcagagagctcagcacaccagagcctttaacactcaagcacagttttctgagaaagaaacacttcactgttaaatcacagcaacgtacttgttccttcattttttttctaaaaggacaggaaaaaaatgtacactcagtgagctgatgtagattctagttacagggcagtctggtttttgcttggtgagaaagccagctcaagtattggtcactgttgagaatatacgtgagacccttacctgttccgagtttgtgaggtcagccaccaccatgcccgtcacaatcaggcaggggtgactctggagagctccatctaggctccctgaacaaaaagagcaagctctcaggtctgcagcagattctgtgtgtcctatcaccagctccctacctcagtccacagacccgtctaatctgaccttgccaccttcatgaagacttaatcattcccatccccttatcagatgaatgggtgggcattattaattaaatatcctactgcttctgtgccctttcctgccttcttttctttgaattaaacttatttcttgaggagcttgaaaaaaaatatcttattcttatgaacttggtctggttggaagcatctagagcggctgtgatcaggtgtgtggggaaggacatctccaccgtgtaccagtgagagctagccaataggttcagcctcattcagaggcactgaaatatttctccatgacaccgtgggtttatttattgttgttgttaagttttatttagttttaactttgcttttcttttttatcaaagtattgcatattagtgcttaaaaataaaataatatggaagagtctatagtgaaaaacaacagtctcttccctctccttctaacccatctcacccccagatggagatgacttttcactctttttacactttctcctgatatataccatcctatatggtaaatcactaagcaaaatgcacatttcactgtttttaaatgaattttagtcttatttattgtctttttatgatagacaagaattcggaacacttaccttcctacctattctaccccctccatttatatgtggattttattctctatgtcagttacctttttacatttaaatactattacaagtttgttcatgttacattaactacagagaggagctcttaacttcccaatttgtaaactgagattagtcccccgccctttcctacaagtccctttcctgtccctaccacacagcaacttctgcatctttgtttttacttttacatcattgaggttgatggcatttacactctgtcctgtaatcataactaaaccttccttacttttccattggttgattctaaaagattaaaatcaataaatagcatttactttctcataactaagtgattatctttcatgatagagctaaggagtgccctgtgattgcaattctttttgtttcactttttgttttcctggagttttaaattgtttttgttttttacctgaaatatttaattttattacatcctctctctccttttttcaaatcctctcagctattctgttgcattgcccttttccccaagtctgtctctctgagtgccctccatagccctggtattgtctggactactttttccaacctctacactaaggccatcctgggacctccccacagtgctccctcatgttggggcaactgtttcctagatctcatagatcacgtgatttactccctcttttgtctggagtgcattctcttaatgatttactaagaaaggagtgcaggaagtaaattttctgaattcttgaatagctaaaaatgtctcttttttcacacatttgaaattttagctgtatgtagaattgtagtgtttttattaactctttattcgtcaaagctagagggtatagctccattgtttccagcattttgagatgctaaagataaacctcatgttggtctgtgatatggtttggctatgtccccacccaaatctcatcttgaattgtagtttccataatccccaagtgtcgtgggagggactttgtgggaggtaattgaatcatgggggcagttactcccatgctgttctcttgatagtgaatgagtgctcatttgatctgatggttttataaggggctttttcccctttgctgggcacttctccttgccaccatatgaagaaggatgggtttgctttcccttccaccatgattgtaagtttcctgaggcctctgcagccctgcagaactgtgagtcaattaaatttctttcctttataaattacccagtctcaggcagttctttacagcagtgtgagaatagacttctgataattgttcctctgcaaatcaccttttttctttccaaaagctttttgaattttgaaataatatatctatgtgtgtgttttcttttcacttatcaccgtttcatccatatactttcaatcgttcctcctgtttgaactgcatttctgagtctcatacgatgctttacctggagctctgagtccccatgattctctctgaggtttcagctctgcaagtgtccaggttgctgtgccctccagcctgactcatccctcatgacccttctatctactttctgtcttccagaaacatgaaatctctcagccctcccctgttgtctttattattgtacatatattttatttctttattatcattgcaattaggtttctggagggaaaacaaactaatgtgataaatctactaacttaagttggagacttccagtgttttcttaataaccatcttcttgtttaaaaagtaacctatgcagtatggaaaataataatcccttgtcattgcacatcacactacccgtaggtaactactgtgagaaatttgataaattatcctttgagatttcttttctggaaatgtatatttgttcttcatttatttgggtttttttaaaaaaatgattaagccattttcccaacaccatcgattgtggaagtcttcctttccctactgatttggaatgacatctttattaaatgtaaaattatcatacaaaccagtgtgcattaaaggtgcctgtccactactgatggttgcctcagtcagatgtcaggtggttccagaaatacgcttattattagcaactttaaaaaataaatcccctgtccctatgcttcctttttaaaaccacctatctatttcttcttatatgcgaacttcagaattattttatttgactctctactgaaaagaaattcattggtttgctattaaaattaaattcatttctttaaccaatattaagtatttaccatgtgtgaagccctatgtaaggtgctaaaaaatgtacaaatgaataaggtgggtatggtctctgccattatgaaggttaaatataataaattcagttctttccaaactgatcaccattttgaaaactttaccatgtcttttctcttattccagaaacataggtgtttctattccttttttctaaataatatccttccatttcatcatgtgtaatgctgctatgttttgtttttagccttctttttgcaatttactaaatgcttatgatcctacaaactatttgcccagtatttctttatattatttttatcacttaatttgaatttatcatcaaattgatagtagtttagaactagctatggatgaactgattttagagattacttttttttacatgttgagtttttaattttgagccattaattttgagttgccttcataagtcagtgtagaatatattcaagtaaaagataaggccgggcacagtggctcacccctgtaatcccagcactttgggaggctgaggctggcggatcagttgaagtcaggagtttgaggccaacttggccaacaaggcgaaaccccctctctactaaaaatacaaaaataagccgggcgtggtggcgcacacctgtaatctcagctattcgggagactgaggcaggacaatcgcttgaacccaggaagtggaggttgcagtgagctgagatcgtgccactgcactctagcctgggtgacagagtgagactctgcctcaaaaaaaaaaaaaaagtagaagatacactttaatacaaaaatatattggttgttaaaaaaacacattgaaatattaaacattaagtattagcaatagacagaaaggaggagaagcttcagatcagcctaaattttgatcctttgtcaaaacttatttccttattactagattattgtggaatttcggttttcccataactcaaaggttctagcacaacatatttagatgtttcattattttccctggaatgtgggaaatcccttttagtcttcacattcgggtcttttttcctacacagaagtttcgtcctctttgtctttggttatcgtgtctgtagccactctggtttctctgtagaagcactgctcttcccagccggtaggaaggctcatcttcttctttacacctccatgtcaccttcctctgccttgtgggagaacctcccacattttcctcaattttcctgacccaaatttttctaattttagttttagtttccttgcagccccctcatctccctttttgatcttatcttggacttttagaattctgttctctttatttttagtgtgacttccctttcctttattctgcaccatttgaccctcacagttccgcacctcaggaaggagaatgcctcccacacctgatacctggccacagacaaagggtgagagtcacctttgactctgtgttctgactttttaggtgctactgagctcttctccggtgtaaatctggaagacagtctaacccatgtgcatctggcatggatcgtctgggctgagttgacatttttttttctaccttcttaagaatttttctttgacattctatgtaaattagtacacatggaaaattacaatcttccttaacacccatttagcaaaggtttgactttccaaatctgtggctggtgtgagcccagcatttctgagggaagaatagtacagtggggaagagaaaaaccttttccttctgcgttctcatggctggggctgccctgttccctacagggaagaaactgggcaagaccttgtctggtttcaccagtgccatctgtgttgcagttagagattttcaacattcatttctaatggcattgtgacttttcatcatttctgtgtgtctctttagacatgataacacaaagttagtaaaggtctccctctgccggccaggcaccactgcttgctggagacctctgtctggagagtccacactcgatgtggtgtatggtgtgctgtttgtgagcaagtaaatgttttattttcccttccagcagcaaaagtgtgactacaaaccttatagagcaaaagaatgtccctttgtccaaagcgtcgctgcctcgcaaggtgcctaccttgtccccagaaagctgctagaacgccttcaagattgccctgttggtggtgatgcttcaccctcgtacaccgacttgatttttagaaaataactaaaatgtatttggggccaggcacagtggttcatgcttgtcatcccagcactttgggaggccaaggcaggtggatcacttgaggccaggagttcaagaccagcctgggtaacatggtgaaaccccgtctctactaaaaatacaaaaattagccgggcatggtagcaggcacctgtaatcccagctatttggtaggcggaggcatgagaatcacttgaacccaggaggcggaggttgcagtgagctgagatcacaccactgcactccagcctgggcaacagagcgagactccgtctaaaaaacataaaaaatcaagtgtatttggcaccaggtatagtcactgatgcaactcatggacttaggaaatgttgactagagatgagatgttgctatgcgggtcatgaggcaacatcaagctctcagggcaagtcggcacaaggggcccaaaagctttatgataaatggcaacaggattagaagaggcaaagaactgcccaaaatgtgagaatcacggcttccttacatagaggtggagcccttatggatgcatgtatgtaaaaagaaatcttattatataatctttataaattccattaatagtgtttattgttttgggtttttaaaaatatttcacactgtatttcatcaccataacatctctaagggtgccaccaggctttaaaaattcatattacacaaatgaagaaactgagggttgaagcaccgtatagaattaattgtagaaccaaggctttctcaggcctctgaggtgagccacattctgcccctcaacccagggatgagccacgaggcagagtgggtccacatttaactgtcctaatttttagtacaattatatttttcctcagtgcaacagcctcatattacaaactaagagaagggaggaaaggagggagggagggagggagaggaaaggaaggagggagggaggggaggggagggagggagggaaaaaagagatgatctagcactcactttatgtaactggtcattttacttggggctctgtattagtcagttctcacactgctaataaacacatacttgaggctgggcacggtggtccatgcctgtagtcccagcactttgggaggccgaggctggcagattacttgaggtcaggaacttgagaccagcctggccaacatggtgaaaccccatctctactaaaaacacaaaaattagccaggcatggtggcagacatctgtaatcccaactacttgggaggctgaggcatgagaatcgcttgaacctgggaggtacaggttgcagtgagccaagatattgtgccactgcactccagcctggggaatagagtgagactctgtctcaaaaaaataaaaataaaaataaataaataaaataaagacctacctgagactgggtaatttagaaagagagaggtttcatagactcagttctacatggctggggaggcctcacaatcatggtggaagacgaaagaagggcaaaggggtgtcttacctggtggcaggcaagagagcgtgtgcagggagactgccatttataaaaccatcagatctcgtgagaacttattccctaccatgggaacagcatgggggaaaccacccgcatgattcaattgtctacacctggccccgcccttgacatgtggggattattacaattcaaggtgagatttgccggggggacatggccaaaccatatcaggctctgagtaaagaaacagtgtggtggctacttctagaaaataacaaaccacaccagagtaacacatccttgcctccttctaaagccatgaagcaggcttgtccctgtgtgtccacgttttgtggccaagagctttaagcaggaacagtactgtgactccgcgggccatgtcactgctgttgatgctgcacaccccagccccctggttccatccagtggcactcagcctagtgacatttccagcacgatttgttctggaggcatcaagagaaagtttgcatccatctcattttcatttataacatttcacttccaaattaagaaatagaaaaactaagaatagtgtgtagtcatatttggcctagatgaagattatttgtacaaaagaacactataaaaagcagaaagaagcataggatgaatgaatgtttccaacaattgagaacaaaagcagcattcttcctaattagcatgaaggacatagagggaaaaaatagtcattccgggagaccttacattttctttcttgattgcatgcagacgaaatgtgtttgctgagagagtaagtgcagggtaccctgtggcttcgccactgcccccattgtggacatggaatcttgcaaccacaggccccatgtggctctcacacacgtcccatggtagggaataagttctcatgagatctgatggttttataaatggcagtttccctgcacacgcttcagcgtcctccagtgtggactcaaagaccagttacaacatcattaaaaaataaaagtgttctatgtaaagcaagggctaggcagagacgttgaattatatttaaggacaaaagtgacatatatttttttcttatgattgtaaataatgaccaaatcccatcattataaatgcctgtccctgcctttgggccatgaaacagcaaagcaggacctttgtagaatgttgctggcaggatgtgccacctgtcagtgccagggccaggatggagagcaggggggagggcatggtccctgtggacatgcaagccaggttctggggcaggccaggctctaggacgggccagtatggggagcagatggtgggaagaaaagcaaccatgtttcagacatcacagaaatggagcaggttgaaaggcacgagagctggattacagctgagcgcccctcctgtgttcacgggttatgtacctcctcaccaccccagtcctcaggaactccccatgaccacagtgggcagctgcagacctcccctcctggccatgcgccagcagccgcctgtcttaggccctcacctgcttgccgctgttccttctgtttgccacatggtcctgatttaggtcaagttattaagaaccttgattaacaagttttaattgtgggaaatgggggagatgtggcactggaatctcctggttaactgaggctccagccaaggcatctggctatagtcgtttctgttaaaataattattaagtgtagtgaggtcgctctctggctcgccaggaattgtctagtgaatgtactgctgtctttagtgataaaagatcttgtaagaccacaaagtaatcattctgaacagtagatctcattatagatagagaaggggtgaatgattgaacgcgcattagctggcttctagaacattctgggattcacctggggatggtctttttggggcattaattttctcaacactttcttcttcctcttaaatgtaaaattgtatttttttaatctggtttttggagggctctgggtgactggatgaattcccagaagccccggtacccctcgggctaagtagagagccgcacagagcctgtggtagtttcaggtttgggcagaatcaggcgcatgacccttaagatatcaaaccaagttcgcctgaagcccagagccatgaaccaatttccctaattagctagagagtgtccctgggtattttatctttaaggaggaggaattagagaatggagccttcaacagcccaggctgggatgcttctcaccctgtgtcgctctctggggcctcccgccagcccttttccggttctttctctgtcccgcctccccggacccctcgctgcccggtcaggtggttagttgtgcgtttgcctggtactgcggtgtgaaagtcaaggcatcagctggagagacgagacctcaaaacccacggagcagcccccacacccctcacccccagggcagccacacgcagtgacatgcaactcccagtgtctttgggtttatttagcaagaggtaatgactgggcggcccctcagagtcccgcgccagtgcagattctttataagccagatttcagaagctcgcaggctggctgtgtcaccactggctccggcccccggctcccgtgtcgtgtccagggctggggtcggcggtcccctggcttctgtcgtgcgggggtcctgccaagctgctcatgctgtgtttggcgtttccagggagtactacatcaccatggtgaagtgggccaccagcaccaaggtcgccgtgacctggctgaaccgggcgcagaacgtgtccatcctcaccctctgcgacgccaccacgggggtctgcacgaaggtacgcggggctgtgggggtggaggggagacgggtgaagaaccgatggtcagacgcgcccgaggtggcgccagagtcgtctcagccctcgggcctgggacttggggaccggccgcccagctgctgcggggagcccgcggcgcagagtcccggctccggcgtggctgccacctcgtggctggtgcaggcgctgccgcagacccgaccgaacccatccgtgaattgccagaggcgccccgtgcctggcacctggacgccgtccgcagttcactgagtgttgcttccctttatccgcgctcaccgctgtgacctaagtgagcgtcctcctcgttgcagctgatgctcagagaggaggggccctgcctttccccagaccccgccgacagcctcccccagcgggctccaggcgtgcgtccctccccacgtcctggtgaggccagccatgtttctaggagtctcaggccgactcagtgtgtagtgagagaaggtaaacgtaggggaaagaaaattaaaatgctcaaagagtgagcaaaggaaaaatgaagtgtaagagaggttgcccgggtggagcaggcaggcggcccacggcctcaccctcgccccatgggatgggcccccagaagcaggtcaccttgtggcgggttttgtagacatcaaataatatcgattaatacattcaggcaggcctttcagaaactcctttttgatcttaagtttctgtctcctggctgaggggggccaaggcttgcaggcatatttacttgagaggctcctaacacgacagctgtgcctgagatcctaagcacagtgattgtttctaaggtggtcagtcttgcctgaccttttatctaacctggggcggattccaggctattctgatgagcttgcttgaggggaaggaaggaacgtgaggacacaaagcaggcagctaaaaatggcttgtaatctccaacttctccatgcccctgagccttgagtgtcagtggcaaacactgcttcctgctataacccatgacagaggcctgctccaggggcccggaggtccagtctgcaccagcaccaggcccacagcgcctccaggtgacacatgtgtgctgcacagcttgagtttggtgtctggagttttgtttttcttttgtttgcacctttccatagaccactgtgagacccacttttcctctatgctttagcccctttgaaagggtttctggtccaccaggagtgttactcagtattccagaatgggatctggacacaatgtccaatgttctgactcagtgtaggctgaggttcactattagatggacacatgcccgggcagtgatgaccgccccctggtacacgtgccatcttcccccagagggttcttttccaccacgggtttgtccttgttgctagggatagtggcattttctaattcgaggacgcttgtgtttggctccgagccacgcacgagacaaagaggagagctcgggattgcctcctcccagagctgccgtggcagctgtgcaatgcttgtgcagcggccatgtaggtgaagccaaattgtttcctgcactgtcggtcacagacacaatacatgcaaaaaaaaaaaagaaaagaaaagaaaaaccctcttgtctaatgctctcatttcatttcagaaacacgaggatgaaagtgaggcctggctccacagacaggtaactactgcatgtccgggtccccactgtcacctccacctgatccaccccagggctggccctcagagcttcgacaacagcagaatggcttctcagagtaaatcacacagggctccccaggcagaaacagacggcgtgccggctccactcacggtgcctcccgttctccagggttgcccagagagctccaggagaatccaagttccagggagggtcgtgtgaaaatcacggctcttcagagcgtggaatgtttggtgagacctcagcttgcagttagatgccagcaccttgctgaattgaaaatgaacagtccatcaaaggtggcttaacataatctactatagtaaaagggtggaaaagtggtggatatccctgtttgttgccaggggtggttttgttggtgtctcatttggagtcacctcctctgtgattccgtaagacccgtcctcagggacataactgcaaaccatccctggagagtcttcatccctaactcagataaaggaacacacattaaaacagactctaggaacttgagaccaaaagagatcaggagaagcccaggtaaatcattctgagacaattttttctaaattaaacttgcacaaaaagtatcagtattttctttcttcaagcctttttgtctcattccacactctgacactaagaagaacaggtgaaaaagctttggaagcttcctgtctccttatccttcctaaggggatgaaaattgtcttaaagactctggaaaaagtcaagccagacttcagtctcatgaattatggtagagacacaggtatgcttcttcatcgatatggtggatcctatttatggaaaataactgaagctggacaaaactatcgccatggctctccaagaacattccagcactatagatgctgggctgctgcttctgcctgtggagtcaggaatataattatctcagaagtcagagcctcatcaacagacgggctgctccgaaatgtatcctgtttctgctctgtgtcaatcttattcacaagaggaatggttccacatggccactttcattttacatgtcccaatttgggtgccaagtccaagccaagaagatatcgggaagagggaagacttagggaaccctcaaacattagcatgctggaaagttcttgaatgccacctggaccaaacatataagcatataagcatacatatcaaaaatagtattgtgatgttcatctcacattagacaaattgtcagagagattacaataaaaggaacattttgtaaactccgttatctatatatcatgtgttcaaccaatatttatggatcttaccaggcaccatgctaggctgtggatttcaaaaaatgagtcggctactatcactgagcacacattgtggtgtgtgtcagaattttattccttcttatggctgaataatattccagaatatgtatgtagtatatatcctggaatattatacatatgtatgtgtgtgtgttatatgtatatatacatatatatacaatataatacatatactggaatattattcagccgtaagaagaactgaaatagtattccagtatattccagtttgtttgtctgttgatggacatttgggttctgtctaccttttggctgttgtgaaaagcacatctaataacagatacaaaaggctaccttattgtacaattccatctatataaaatatccagaataaataaactcatagacacagaaagctgatcagtggtgtcccaaggccgggggagtatggagaggaacagcttaatgaacaggggtttattttggggtggtggaaatgttttggaactagatagaggtggctgcacgtcattgtgaatggactaaatgccactcaattgttcacttttattagtacgttttcttttgtgttatgggaattttacctcaacgattttttaaaaaattaataagctagagcatgagctcttaaagatggtacatcctagacagggagatgagatgttcacgttacatccattgtgcaggctacgagggtgatcctcagacattcagaagcattgctgaagtattcgggtgttggtgggagtgggagccagaaaaagcgtggtggacatggagcaggaggccctatgccaggcccactttgtgtttgaacaggaggaggtgagggacgtgattctttgttgggggcagggaggctatgggaaagcaaggtggacatgcacactctgcttccctgtccccctcaagaggcattctcacagggggagctggcttcccagctggccacctgcagttctgccctctggatggacggcagagtgcatggtccctggaggcccatggggggccgtggttctgtcctccagcgctcacttcattagctctacagagtagctacagagccgaggtcgtcagcaggactttcctgtattagcgattgtgtgtctcatcgcccatatgagaacagctactaaagtgtggggtaagacagcctgaatgggattccagaaaccagatccttccaagcagaatccagtcaacacttaaaaggtggcatgaattaaaataattcttactgttttcaaatgtaaagtttaaagcatttactaagcacacagctaaatttttaaaatagctgcttaaacgtatgcaatgctgccatgagttggaaacataaggttctgtgacaggtgtgttttcctgggatggagcgtccctgggtcaggtcagcccatcagctgcagttgtgattgtgacactgggttggggcatcccgcccatggcagcagttgggaggccaggatgtctctgaagaccctacaggttgtgagtctgcacctgtgaagattgcagctccatggtctgcaggaagatttaatttcaaacagtttcttatgacattgtttttttcgtaaaggaattcatggaccctatttttcaaaaacaatctgtagtgtttctgcatccctcgagttactgtgatatcctggagaacaacttagtaactttttaagactgaacctgccacctgctgccagcgaagccattggctgctgcttcagacagagcctaagggggttttcctgggagggctgcaggcatgagtgagggagacacatggaggccacatgccctctacccatccatctccaatgggtcacagaagcttgccccagctggcccaggagaaactggcatctggaaggtcctgcagacctcagggagacccggcctgcttaggtccaccgatcttccaaggacccggtgcaagaacagaggtgagttgtagcgagcctgctaattttgtgtcatctgagctgttcatctgagccgttcatcctcctctcttctcttcccaactccttcctggaatcctcagtacggtcacccgcagagattccccatgagccaaacagaagaggaaaatgcatgtgtggagacccaccaagttccctctcctctaggaatattccagagaagcaggcaatcccccctgccacatacacaccctgtcactgctgcgctgaccctgcagagtcagtcctgatgcagacccatgaggatcctctgccagaaccatctgcatttgccatagaaccccagagcctattgttttggttgaaggatcggttccatggatccatttctgactgtctttattcttttatcggaattttggttttgtgatttcaaaatttgggctggaaggggggttggacaaaattattatatctgaaccatgggaaaaaaacactggcaaaaatgctacaaataactcacaaagaagctctcatgagtcaaaagggctccttcttcacagatctgctgagtggagttgaggaaaccaggcattgtgtgtgataaattctgttatccagagagactagaaacgcttcccccaaaatcaaatgagagacagaaccaggataaaatccaggtcccctggtcaacaatcattgcactttgtcactaaaaatacatttaccacatgagaaaccgggtctcagagagactcagaggcttcacctgtgttccgaggaatgtttccctgacaaggtagagatgacatcacaacggtggaggccttcttattataaaaacaatgcttctggccagaattaattatttattacatttatttagagtatctttgtctgccaaacgtgcaaacatttcccccagaaaactgaaggaatatagcgctacccgccgcacagttggcaaatagaagtgcattttaaaagccaaattaaccgctggtttttccatttcctctgcttttaaataccatgcttccaactctaaataggaaaataaatgtttgcagattaaaggttccattttattgcaaatattcatgaagattaaatgtcattttaatcacatgttagtttatttctctgggcatatcatatctgcatgggttcactcactgtagggaaatgagttttgcttgtgccagctggggtttatttaccattagttctcatccccgcattcgtgtgaagctccttgagtcagaaaatacatctcgcaaccaactaattggtgttcacggatggaaactttcaaacttgggcttcagagaggccaaggtaccgcggtagcaaaatcctttttcgcccatcaaagcaacagccaccctgtgggctggtggaaggctgaggccgctggctgttcactgtccggggaccaggcagagatggtggcgacacctgccctaaatccagcctggaacccttcccccagggaaaactgggcatgctgattctgtttccagggaaaagagacagtagatccaagcaagtgttgtcatccagtgtggcccgaggtggagcgtgtccctgggactgctgtcccctcccacctgtgttttagaacccgtggcatttgtccttgtgtttattttctttttttcttgccttcttgatgggctattcagtgtgagatcaattgtattcaataagaagaaaagacaggattgaaagaatagattttgcttttaggcaaaatctggtttgggattgttgagaattatgtttttttctgatatataataaatgccactggagaaatctcacaatacactctggtttcaatgggcaataattcaaggaggaagcacctccttttgagttttgagagcagagttcctgttctcactggtgagcttggcgtgcacatggggctgggctttgtctcggtgctgtgtagactgagggatgcctttttatttgccactgccggggctgtagcctcttaattcctccatcttcttcttttagaaaacgtaacagttgactcatgattcccgaggaaagtgacggcctcatcaagcacttattatttcaactgttcctctccttagaaatcacatagaaaatgtatctcggggtgtattttatcctggttcaacctcttcagaataaatgatgttttagttgtggtttcatccgtggcctttgtccacagaatgaagaacctgtgttctccaaggatggccgaaagtttttcttcatcagagccatcccccagggaggacgagggaaattctatcacatcacggtgtcctcgtcccaggtaagtcctgctagtttccggagctgaactagaaactggcctgctagaggccgtggggtgacagcctctagggctgggcacacttgcgttttcgaggaccccaaggaatctgaaggtggttcccgaaggcagggcagggcatggcgctggtgagtgcagaggttcccatcaggcctggtggaaccttgctctatctggtcacgtgcgagaatgtgaatgacgcttctgccaaggtcagcagagaccctggggtcccctgttcagtgtaaggccaaggatgttggaggactgtctgtgccgggggccctttccttctccctctgctgagggtctccttaacatactccccgctgaggcatggctccatgcactcaacatccctcaggggtccagcctcccatgctgccctacctccacccggagttggatgcaggtattattttattatgtgaccgctaccagccatcactcactggttctggggtctggcgagttcggaatggagcatccctgagtagggaatctcagagattaatatacgtgaatctaggatcaaaagtagacatctcggggtcaccatctcctgaagaggtcacctcagggagcctcacgcctgcaggacggggctgccatggtgttgactttgggggactctgccctgaggaagaagggaagcatgatcttggatctcctcagttttggaggcagtctaaagttatttgggatcagggtaaatgaatgaaatttgattagagaaaatgttaatcacaaatattctatggctatgacatagaaggctcatatttatgatgaggcctcaaaggcaatttcaaaagaaaatccaagaacatccgcactaagagcagctctgatggaatcagggtgggggctgcgggacccctgggatggaatcggggtgggggctgcgggactcctgggatggaaatggcgtctcttggaggttcaggtgcaattttttctcagtgcacttcatgacacgattgatagaatgtctgcaagctgttgcctttgctttttcctgcggtcttcattctaccatccaaattcttttgtttattattttacatcacttatatcaagattttaaaatgctggccaggtgcggtggctcacgcctgtaatcccagcactttgggaggccaaggcaggtggattacctgagatcaggagttcaagaccagtggccaacatggcgaaacaaaaattagctgggcatggtggcacctgcctgtagtcccagctacttgggagactgaagtaggagaattgcttgaacccgggaggcggaggctgcagtaagctgagatcgtgccactgcactccagcctgggtgacagagtgagacactgtctcaaaaaaaaaaaaaaaaaagatttataaatgcttcagtgttttcatttggctcccagtcttgtatttatccaagttgccatcatttgcccggagccctatcaaacattccagcaggaagcaggtctcctgcactgcccatgaggcaccacctcctgcaggttcccaggaacccctcggggggcccccagggccttccctttcaaaacctgcttcaaactccccagcctctcctacacgctgtctgcgcccccaggccctgctgccccccaacccccatgttcgagtctgcagcccacagagtgtgtgccttgggccctccacctagtttaatctccacctgctctgcgcccacctcccagggcatctgccttccagaacagctgcccatttcaaatccccactgaaacatcgctcccgcctagatggccctgtctctctcttctgttaccattggtcgttaccattgtctgttaccattcttcttagctcaaggggaacatagggaaagacaatgcgtgcaaaacttgtagtgtggcaatacaggtccaaactgtccttgtcagtggcagcagggagcgccctttctccctccgtttattcttctctctttttccctccacctcccggcatttgtctctttcctccctcactggtcccccttcagtaatggctccattaattagatttacaaatgaaaaaggcctataaagcattgattctcctcctgagatgcttccatcatggttggaggccaggtccaagtgattcgcgtcaccaaagaggacagggcactgttcccaccactgacattcgggggtcggggaggctgcgggcctggggttggttgggaagcctcaaggaggatgttgcctcccaggagaggagcaggcagaaggggcagagagcccttcccacagagagaatggcagcccctgtcacctggtgtccaaaacagttggaggatgaagagccatgctggggccgggacaccggtgtctgctcctgatgccatgtctgtgtgtttcagcccaacagcagcaacgacaacatccagtccatcacctccggggactgggacgtgaccaagatcctagcctacgatgagaaggggaataagatgtgagtgagaaccaggggcctgccccatcttactggccaatggggcacatttgttattttttgtcaattacacttatggagtacaggagcacaggaggcctcctctttcctcctcaggcagcatcactgactcctagtttcttcatgaaaatgtatagtagattcccgtcccaacagtccgacttccagagctgcggcgtcctgaggacgcaattaggcttgcagccagcccatgaagggaagcacgctagcggcagtagtaggggtagtactgatgttgattgagtttttactagtccaggctctaagccaagtgctttacagacattatctcattgaatacaacagttccatgaggtgagtttactgctttccccattttaaaaataagtaaatgaaaacaaaaataagtaatttgctccaggttattcagttggtagcgggtagatttggctcagatgaggggagcccagttcggaggactttaccaccatacaatttcacctccctgctcctggggtaaaagccaaggtttctgcattgggaggtcttaggtgaaaatgagtcaacaactatttattgggccaggctatatgtctgaacttgtcttaaatgtgctcagctccttgcccttcagaaggtgagtgatcttgtaaaagatttccacatccacattcaggtgtgtgtcacccccaaccacagtaccctctggccacgaagcagaggccagtgcagggggcacccggagccagtggaatctgcactggtgtccctcagcccttaggtgtctggccaccccctgctctggtcacaggtgtagctggacctgaacaggggagctactccctgcaggccatgggcggcagtccctgaggagtgtccatagaggtagtgccaggaatgtgaagtgcagacgtgccttggagcaaactaaccctgtgcaccttggtgatctttgcagctacttcctgagcacggaggacctgcctcggagacgacaactctacaggtaactcctgctccccctgcacacagggctctcccccttaggagggcatccaggctttgcagaattgcaccttttcagcagttcggaaagggcggcagcaaagacagaccccaccacagaggagtagctgtagagtctggagagaagtaatgaaacttgcagaggccaccaaaggggtagttttgagacttttgaagctttatttttctgctgttgttgacttgggttttccctgtcacccacttgcctctttggctaacggatggactttaacccgtctttccttttcacttctattcaatgtcacctcggaggaattctgccccccctgccccaccacagattttttgtagggagcagagtgtgatttggaaacaaacccgtgggtcagcacgaggaggccggccctgctgtccggcattgtagctcactggctttggggaactctgccctgaggaagacagggagcatgatctcgaagctcctcagtttggaagcagtctaaagttatttgggatcagggtaggtaaatgaaatttgattagaaaaaaaaggttaatcacaaatattctatagctataaagtagaaggctaatatttatgatgaggccctaaaggcaatttcccttctcaacagcccaactgtgcgactttggacaagtttccaaatctcaaagagggcagggaccctgtgttctgaaccctggagggggactggttttttttctagggcgtgtccctcttctacatttagtcctgtcatctgcccagtcactgttctcactaaaggaggctttgggttgtgaagtgagattagccctgggcactttctaccagggccacagaggtgaggagggggtgtctgctgcctcccccgtgcctctgcatgggatggctgcagccagttacacctaaaggcacctgggccgctgaagaggatgttgttcaggggagacctgaggcttgaggccagtggcgcattgtctaaatggtgccaatgcctgttgcccccgccccactgctgggacattgggaagcccccctggtgaacgcagcctcccttcccagccatcggccgctatgcggacaggatgaggtcagcatgagggagccagtccgtgtagatgttccatcgtcaccatgtgtctactaggaaaattgaaatacacatgtcaccaattaataaacatgagaggctgcctgtggcccctgtcctctaaattacagaatgagaaggttgtcttctctctcccgtgaaatatctttgctcctggaacaacagacttcatattgaaacctatggttagaggggaccctcctgcggcaaaatgttcagataagaacttcttccaggtagatccggtatcttaggatctttccattttagggagcacattttaggccttcttgacttgaaatgacacttgaccacagtggtcccaggtaacatcttcaagccagttcccacttgtgtagctccgttgagtgggaagcgcgagctctcgaggtttcactctgtcaggggatgtggcttttggaagctgccagagttcaattccactggtgctgctggagcccctgcctgctcacatgccagcgtttggaacccagataatttgaagatatgtcactctgtctactgttctcagattgctagccatccactcagagggacaggacacgtgcagatagagtgctagatcatataacactgacagctccatgctcctcacaccaggccacctgcagagcctggagaaggcagcataggtgactgccttccagccctcccacaagcaaggatgctgaaagctcttgagagtgggagggacccaccagcaaaggaaggtggaaatggagctgggtggtctcaggggctccagcagggagacagagggagaggcccggggggtctgtagcagggctccgcagatcaccctcatggggagagcccaccagcttgcggcacccagcgtggagggcagctcctctccgcccacattcacacctgcgtcctttgctcttccagtgccaacacggtgggcaacttcaacaggcagtgcctctcctgtgacctggttgagaactgcacctacttcagcgcttccttcagccatagcatggacttcttcctgctcaagtgcgaaggtcagctcctgccaccccgtcagggcaaagagccctggcaggcacatttgcagggagggggtgggcacacttgcagggagggggcagcggctgtggtgggagcacagcgtattccagaacaggtgaggatcccgcctacctgataacattgcttatggtgcaagatgactggacccccacagagcctggtgcagtggggctactttacgtttcatacaggtgtacagcttatcagagtgttctgtgcacactgtgccagtaatctctcagtttgtctcccattgtccacaaaaaataatagtcccatgagctaggaagggcaaatatcctacacagtgatgagccaaagccatcaatccatcaataaagataggaaaacaatttcaaagattaacttttcaatcatatttaaggatgattgaatatcaccaggcacggtggctcacgcttgtaatcccagcgctttgggaggccaaggtgggcagattcacctgaggtcaggagttcgagacctgcctggctaacatggcgaaatcccgtctctactaaaaatacaaaaattagccgggcctggtggtgaatgcctgtaatctcagctactagggaggctgaggcagaagaattgcttgaacccaggaggtggaggttgcagtgagctgagatcgcaccactacactccagcctgggcaacagagtgagactccatctcaaatgactagataagaaaaaaaggattgaggttatgttaaagaagtctcagaaaaatatttccctatgtcccaattcattgataatttatcccaaactgcaagagtttgatcacaccaaccagcatacacaaaagagtaggccatgttgcatatgggatacaaaggatatttttgctgcttgtctgtatcttggaaagatatgatatgaacccatggaaaggtaagtcatcctaaatatggtcgtaacaaaatatgatctcctgcgatgacctcaaagaatgaaaatatgccacaggcagagactaagatcaggagcaatttgctcctctgtcagagtttcaatcccctaagccataggtggagaatgaataacttttatcagagcaatgtctttgctagcctttgctagctactagagagctcatgacttcatgacttcgttctctttttatcagtgtcatctaaaatcttgaaaatccgcagaacagggacactcagcctcttgctcaacacaagctcagcccctgacattcttctaagacagcaaggagaccacggagggatgaggggggtgcgactgaaatataacattagtgccccagtccccgcaacgttaatggtaccaaattcctctttcctgtgtgtcccaagaaggaggccaccaagtatctgaaatcatagagtgctgtaggggaaagaacctaagatctaactgacccacttcatgtatcagatggcaaaccctaagccagaagttgagtggattccctgactcccaatgagccagtgacacagagagggccagcatcaaggtctcccagttcctagcccagtgacatctgtctcctagggcgggatcttcttgaaataagaacttgggaaattacagggattgacggggcatagggattgggaaaatgtggcaagcagacccactaggagccagagagtcttttgaggagctacataatcagaatccacaatcctgtctcagaagcaggaggcagcttcagcacacaggaggtcatgatcaaacacagaagtgaaaaattgaagtagatttcaagaagagtgccccaagcaacaaaggttgaatgagaaaggtgacagagcctccatcgtggagatcctgagtcagggacagaggtcatttgccagaggggcttggtctggcctaggcaggaggcagagcctttgggatctgaggtctgcactggtcaagacagcaactttatggatttgtatttcccaaattcttactataaccagcaagaagggtctggcttctcaccgttcatggaaagaagtcaaaataataatgagttgtgatatgaaggagtgatatttctttattacctatgccaccaaggggaagagcagaaagcaattccactcttcaatttgtggagcaaatacagggtttctttttttaaaaaaaaaaaagaagaagaagggtttggaatggggaagagcttggggggttaggaggtgccaaggagtgtgactggctgtggtggcccctctttaattattgtcccatttgatgaaggagctggcaccattgtggatcccaccaggttatcagttaatcacagtcagccttgtagtcactcttcagccatgagcgggtttcatccttgaagtaatcttttgttaaagaaagaattctggaggtatctgggtcctatcaggagctgactcctggaggttttaaggaaatacatgaccagataagaaagcatggtgtgtgctccacaagcatccgggttaataaatgtgcataaggcatgagagcatagaatgggaaaagaaagggagtggaggcgacagcacattctgaggctgtgtttcaagatgaaaggtaacacatacgcagcttgtctcaaagttgtatcttgagacagggagcagacagaagaggagaggagaaagaaaaaaagtttaaatcgtggtttgaggctgagctgctcggtcatattcctaacacatactaacatctgctccacatggtgaccctcccagaatccagaatccaacagcttatttgttgttgttgttgttgtttgagatggagtcttgctctgccgcccaggctggagtgcactagtgccatctcagctcactgcaacctctgcctcccggtttcaagcgattctcctgcctcagcctcccaagtagctgggattacatggatacataatttttgtatttttagtaaagacagggttttgccatgttggccaggctggtctcacactcctggtctcaaatgttccacctgccttggcctcccaaagtgctgggattacagacaaaagccacctcacctggcccttacttaacaaacactttcgctgcttccctttggaggtcacagctccctgctaagttcaagctcaagttcagtctggatgcctcattctgacaactggaagccttttatggttcagtttccataagctgcagccctgggttgaaatccaaaaggctctcccaggagatccatggccatggatttaggcagggaagttccagttcccacatggtggatgtaaacatggagcccgtggtagatagaaacacagcctggtgttgggaggctgcttggacagagtgttaaagtttagagagcactatagggtggctcctgtgcggatttctagtctgccactggccttctgtcccaagggagattcgtatttctttttatgtttatgtatttgcaaggcttgtgttgtggtctgcaaatagttattgtgaagagatgactccatagttgatacctgggaggaaaacagaagcaaagaacaagtacagcaacacaaggtcagacacacgactgacccagcccccaggtacagccacactgggtcacacacacatgactgacccggaccccaggtacagccacactgggtcacacacacgactgacccagtccccaagtacagccacactgggtcacacacacacaactaacctggcccattgggcacctccacaatctcaccttcagaaaggatgggatgctcctcctgccaatgcctggatccctataataatcaaacagattcctagaatttgaagataggaatagatctcagagcatctaatccagtctccaccctgcctttcttttgttgattcagaaactgaactcttagtcattatgaaattatcacgctagggtttcctgaatcatttaagatctatttaaatatttagcctgttgcctcatcttaaggtagacataaactagccctcttctctacaaaattgctctttaaagtgtttacataataagctattttctggctaaagtaacttttgaatgcccaaattaaactctccccatggaggtaaccaaaatcccacttataaaaagagattttctgaaaaggtttaaatttacaaagacaacaaagtacatggggagacaggagcagccaactgtttgaacctggaagcagttaccagtgataactgacctggcagaccctgaagctgagcctcgtcctgccatggggaaagctgagcaggcattggcgatgattgcctaagggatgagaagatcaattgctatgaaatcttaaaggagaaagtgattatacccatttggattgcttggggcattttgctggaggagaagactcaaggaaggtgtcaatgatgaggtggcatttaaaacaaatgagtaggtaggatttggaatgggaaaaagcagtccaagtggaaggtacaccctgagaaaaagcacaagaaatgttgtaagattatgcaatggaatcttttgcagcatgtgaatcaggatcaagtgaatacaagcaacctgatttaataaacaaagataatttaaaataattttatttttctccacgtttctcagtagatattaaaatggacccagatgtgtagtctagagcaacgtttagtcaatgctcatgtcctgtcctgtttccttcacaccccaagttattctgagagattcttggaaacctgtgacaaaaataacgtctccactcctagcattagagactcttgttttcttctccttccctcctcctgcagcattttgttatataaattaacttagtcttctagttgcaaccagaaccaaaaaaatcctccttttttaggttgaggataaatgtactggcaatgagaggcttctctatggtaaaatctgtaaacatgcccacattcaaagctgttcatcccgtcacacagggagggaagtgtaagtagttcaggttgtctgggcataggaagggatgatcatcaaaggatttaacaactaggacaaggtggataccaaccagccaaaagacatgtccctgagagcagatataggctatcaaaccacattaggacataagggctgggtataaaatcatgaaattataactgtttcatatagacttcaacattcttcctgcctttctgtgggccttccattaggacagtttttggtaagtttagctgatattgacctatcctgtaacttatattcagtattataacttatattcagcaatataactttattgtcttagtccatttgggctgctatagtgaagttctatagactgtgtggcttataaacaacagaaaattatttctcacagttctggaagctggaaatccaagaccagggtaccagcatggttgattctggtaagggccctcttctgggtcacagatgaccagtttctccttgtatcctcatgtggtgggaaagagggtgacagagctctctggggcctcattataagtgcactaatgccattcccaagggttccactcttgggacctaatcacctctcaaaggccccacctcttaataccatcacgttggaggttaggacttaatgtataaatgtgggggggacataaacactcagtccattgtaatcatagctgattgtagctcatcagttgtttgcaaacagtatttctatttcgttagtcctttggcatactgatcttctcctaatgttcagtttttcttccacagtgtattttgtccaacatcattatagagttccatctagcagtatcaatgtgtgctttctctaatttttcattaacatttcttcagcggcttctcaatatttgacatttgtatgcttatatgtttatgttttatgtttataattcttaattccttaaaattttttattgtacatacaaacctaaaaattatttttaggttaataataattactattaacttaaataataattattttaggttaattcctcaattttttttttttgagacagagtctcgctctgttgcccaggctagagtacagtggcatgatcttggctcattgcaagctctgcctcctggtttcacgccattctcctgcctcagcctcctgagtagctgggactacaggtgcccgccacaatgcccagctaatttttttttgtatttttattagagacgggttttcactgtgttagccaggatggtctcaatctcctgaccttgtgatctgcccacctcggcctcccaaagtgctgggattacaggcatgagccaccgtgcctggccaattccttaatttttgattgtacatacaaacccataaattatttttctactttgcacagttacattaaaaatatattcgaatacaatatataaatagaggttcagaaatgcttatagccactatatccactcactacctcactggatcccatctctgagtgtcaatatttatatctaaaggacatgggtttcagatgacccctggatacttgtgcgagggatcagctgtaagccaaactcagtggaacattgtggaaactcacctatctatgtaatacagagagtttctgtccacctctctattgtctggaagtgaagccagctatattctaaatattgtattatgatgtaaccttttatgatgattttccagaatataccaagcagcttttggcatacatacttaattggtcttctcaatgaccctgtgaaatgggtagtaaaagaaataatcttctatttgttaagttctttacaatttgaaaagcacatttcttttttttttttttttttttgagatggagttttgttcttgtcacccaggctggagtgcaatgacacaatctgggctcactgcaacctccgcctcccaggttcaagcaattctcctgcctcagcctcttgagtagctgggattacaagcgccaaccaccacacccagctaatttttgtatttttagtagagacggggttttgcaatgttggttaggtgggtcttgagctcttgacctcaggtgatccacctgcctcggcctcccaaagtactgggattacaggctttgagccacggtgcctggcctgaaaagtacatttctaattacattataacagttgatgactatgttcccatttctgattccttgaaatttatattctagcgtaaatatatctacttagaattccctaaactcaatatcatttttcacatttccatgcttttgtctttgactacctgataaacccctatacattctccaagactttcagggcagggttgattttcatccccttacaggagggatgaatgagaagtcagagaacatgaaagtggctgtgtattcacccgcagaccaacgcctgtgacaggaactcagtcttcagctgtcttagatgactggggatgcccaggacaggggaaggctgggtggtctcaccttctagtcctggataaacccaattccatctttaaagaaaaaaagcactcacctcctggactcatcttctaggacagctaacaaattaccgcaatctggatggtttaaaccaacagaaatttagtctctcacagttctggaggccggaaatccaaaatcaagctgttagccagtgtggtttctcttggaggctgtgagggagaatctgttccacgtttctctcgagcttctggtggttgccagcagtccttggcattttttgacttaccaatgtattgctttcatctttgccttcatcttcatgtggtcttccccctctgtctctgcatccaaatttcccacttcttatgtggatgccaatcattggatgaggacccacctaatccagcgtagcttcatcttaacttgactacacctgcaaagacctcgtttccaaataaggtcacattcacaggaaccgagggtcaggacttcagtgtaacttttggggggacaccattaattaaacccacaacacttcccttctaaggactgcattgccttcttatataagaaagaaagagtgctcagcttgttcttctcaggaacacaaaattaagggcagccacactagactgtgccagagacagttcttaatggtttcactgcattctggaagcagcaagggggtcactgaaggaagtaatgtgatactaccatatctttggatagcaactctagcatattagaggaagaagagcagttccagtatagattctctctaggaatacttcttccctgtcataatgcaaaattcacagtcaagtggcatacagccataacaagttctgtagggttttctcctacccatctaaattcaaccgccagagccactgaacaacagaatcgaagtgcccaatttacataatttgtgtttcacagtcctcgcctctgttgagagaactggatttttctcttcaaaatgaatctcaagagtatgatttattttccttcaagtttttgaaaacgactcaatcaatcctgtttctaagaaatgtccaaatgccaccaggaaagtgagttccgtgtatgaattggccatttggtgcttcctactgaaacattttttgtatgtttaaaaatagctaaataaacttccttctcctgaagccgaggatggaattattgcagtcacttgctgctctgagtgggaacgggacagtctgtgttcatgaatcccttacagctctgggctctcacccccgcccctttcagtgttgagccatgattagggagctactttccagactttaagaagtttggtcttagacttagcagattggtttatcaagacaggcttctccttctccaagttgagtggaaccaaagtattattacctgagcctaaaatacagtgactcaaatctgataactattcttcttactattaaatattccccaagatcttctgtcatcaccatcattgccatcattatcaaaatcacaggagattgaaatggcagtaagggaggtctatggagtatggaaccgtagagctgggttcaaacctggactctgccacctacagcttcgcgaccttgggcatcttggttaaccttgcttaatcctccacaccctcatcctgaaaatcggaggaataacagtatggcagtccccccttatccacagttctagtttttgaggtttcagttacctagagtcaactatgctctgaaaatattataaacaataagatattttgagagagagagacaccacattcataataacttttattacagtatattgttataatagtttgatttcattattagttattgttctcttactatgcctaatttataaatgaaactttataattaggtatgtaggcacagaaaaaacattatatatatggggttcaatactatcattggtttcagacatccactggggtctgggaacatgtccctggtggatatggggcaccactgtacctgtcctgtgaggctgttttgaagattaacctagatagtgcatgtagagtacttaccatggcatctgatacatagtgagtgtttaataataagtgttaactatcataattgttttcatcattgtcatcaccttagtaatcaattgagtttcttacacatccacttgctacccactcagtatccaaaagttggggccaaggctgggggtggctgacgtgcatgaagtcaatgaagcagcatcccttcccacatgttagtgggcactccagcacctcagcaggcttaggttggaacccctggatcttgcacttacactagcaaattccagaagcggccatggatgccagagccacaaaacattaaatcaactgtcaggcatggcaatgagtacctggtggcttccagagtgcatgtgtccaccgtggtcctcacagttggttcctggcagaagttaagaagtaaatttccagctttcttagcacctgcccgttccttctgctgtgacctttcccctccatgccttcaggtgcccggagctcccagatgcccctcctacatcctctcgctgcaaaacataattaaccaggggaaatgtccacgaaggtgccattaaggtgtcctgcaaatatgtatactaaggtgcttgttattcttccccaggttttagtcagagcagtgagtaaggcagggatgaaaaacaggaatcagccaaccagctccacttgttgggaaggcactggctgcagtgctatggatgagaagggttctgaggccaagtgcaggttcagcaggaaagaacatcatgagtgattaacggatgatgtcatgaaagtcgtaagcgattgatggatgacgtcacaaaagtcatgatgtcattaacatcatgagtgatttatgatgtcatgaacattatgagtgattgatatatgatgtcatgaacatcatgagtgagtgattaatatgagcaacttcaagagtaattgatgaatgatgtcatgagggtcatgagtgatgatataatgaaacatgagtgagtgactaatgtcaggcacatcatgagtgatcgatgttacgaatatcatgagtgatcgattgatgatgtcatgaacatcatgagtgaatgattaatgtcataaatgtcacaagtaactgatgtcatgaatgtcctgagtgattaatgacatgagcatcatgagtgattgatgccatggatgtcatgagtgattgaagggtgatgtcatgaatgtcctcagtgattgatggatgatgtcatgaatgtcctgagtgattaatgacatgagcatcatgagtgattgatgggtgatgtcatgaatgtcctgagtgattgatggatgatgtcatgaatgtcctgattgattagtgatgtgtgtcacccacagtcatgggggagcaggtggcagccacatgccatgcatctatgatgtttggtgtaatcccctgaaatgaatgaacacctccacatggtgagacttcagattccatattatccaagatgacatacatttggaagtttgagatttatcctaaaactcaccttgtactgcagaatgaggtgaaggggcttatttttttaagggcctagactcctgaagcattatggccagccaaaatagaagtgacagcatgtcacttcagagaagagaaaagggcatgcatgaagagacgcagattgagactcggttacctgaagggatggaaatggctgtcatggaaactctcctgagggaggctgttgcccagggtttctaactgaagggcacctcttctgtcatacatcttttgaatgagggagaagaaatctccagatccttccagagtggctcaggggtgatactgattcacaccccttcagagtgctggatcaacagtgtaagcaggcatgccctttgcatgatcccaacataggaattaaatattctactgctggtcaaattatttgctaataactcatgcctaaccgtaaatgagtagtcccagagctagaaaaataatacatagtttgcgtcttcattgataaaactgtcttattagcctcaaacatgtagggtgctattgactcccaacagcaaatttgaaaacaaatggtttggttctacaaactagttaatcctctagacatctcttatatcaaaatttccaagaaatttacctcagctgccctttttaattttgaatttatccaagtgaatgtttagaaccggtttgaagctccttggagcattgctggtgtgtttgtaagaacatctgttcagtctctcaaacatttggagccattccctttgaggctgcatgaaccaagaacaaggaaagggattctcaaggcaggttatattgttaatgtaagtgacatgaatactctggaacatgtcacactcttcagtaaatgctaccagacaccacgcaaaccactcatattcctcctcagtaacaaccaaacaaacatcttccatggaaaagaagcttctcactttgccactcaacacctttcccattcctgggcagtggcaggtatgctgaacctggtacgagtgtgcctttctacatcagaggccatgtcctgcagtctttcatctgaaatgtccattaaaaataaataatgggctgggcatggtgactcacgcctgtaatgccagcattttggaaggccgaggcagacaaatcacctgaggtcaggaattcaagaccagcctggccaatatggtgaaaccctgtctctactaaaaatacaaaaattagctggacgtgatggcacgtgcctttaattccagctactcaggaggctgagacaggagaatcacttgaacccgggaagcagaggttgcagtgagctgagatcatgccattgccctccagcgtgggcaacaagagtgaaactctgtctcaataaataaataaattaattaattaattaattcaactcaataaataatgactctagaatgtgtccattccttttatccttgttgccccagctctgggtaataaaagccattttgttactggtcagttttcctgtgagatttcccactagccagttcaccttgcttctgcctgaatatgaccagatggtatttcctaaagaatatctctcttcaaaatggcttccagagcacatacatttctcttttttctaagtaaaatgatagaagaaataaaacaaaaacaaaaacaaaaacaatgccactgggccactaggaaggggccccaatggactaaaatgttgaagaatttttgtaaagtaaacataaatggttcactgttaaagtgaaagccagacacaagggaatgtaacataattggcaaaagacatgattataaaatgaagaccaaaaagaagtttgtttttttagaattctgaattgtggagcacctgtcagagtagatgctgccgcctcccatttttgcccctaagacaaaaggagacttggccagggagacttccagagtggacggtggggctggaaggggagctgtgccgcaggtggccacaaagccaaggccccaagcactgcaagaggccccctcatcccttcatcactgccctgtctccacctggcatcagaatccgcattcacggagggagtggctctatggctgctgaagccatgtgtccacagcctgggccccacctggacgagagtatagccaacagggcaccactgcagcacacgggacacgcgaaagggaggcctcagaccgagcgcctgggaaggaaatccctggagaagcattttaaagatcttgtccatctgctgcagccagaccgactgtaaatatcctccgagagattccagaaggcgtcacctttaccacacagagcggtaaagagtgggctgctgtgaaaatgaaggaagctgactgctcaagacttacaatatttacaaaacaaatttttgtaattcagaagaagaactgaataggtaaagtagtcaaataccccagttgcccccaaaagcctggatcacgctgacgtaaatgaatacggcttcttaattatttctagtgcttcttcccttcacttcctgaagtgttcttgtttggtcaaaattatgaacagaacaacaccagaaagtgccctagaaaatacaaccaaaaggcttcccagaggacccaagaactggacaaagatgaacattcaaacacttttgagagctatgaaaaatagatccaacgaatgtaatctcttggtagaggctttagaaggagagattggggagaaggaagggggaagaaataaatcaagatatgatggaaaaaaactttccccatgcttttgagtcgttagggaaaagaaacctaatgagtgtaattctaagaattttggagaagatctaacgatacatacctcctaataaaacttgacaattcaagtttagaaattatataagattacaggcagggctcagtggctcatacctgttaactgaaccaactaattaaatatagactggccccatgaaacgtgttcttcatgtttactgaaagcatattcttaaggccggtgttggggatgcccttctggctactgtacttcaagatgttctctgcagagggtcatttggaataaattttcctctggtctcaacaccaggaatggttgagcttctcataacctatctaatgggctgtgaattgtgtttccctaaactgtgttggctgctagagagcttagcatgaaatgtgtggcatatgtgggtaggtctttatagcacacatttttaatctttttcctgatgtcttttcttttttctttttacattgttctgatagcctcacttactcattttaagcttattttatttttatctgtgcattcatatcatccttatctgccttcagtcctttttgccactagatccaacatggatagacagataatagatgagagggaaatgactgaccgattgattggcaggtaggaaaattaaagtactcttagcctagcattcaaggctgcatacaatctggccacatcctacttatccagcctcgtaatgacactactcctctatcagagctttcaaacacttttagaggcacaatcagttttcaaatgaaatgttaagtgaatatatatatatatattttttttctgtatatatatatatatatacacatatatatatatatacacatatatatatacacacacatatatatatacacacacacatatatatatacagaaaaaacatggtgttttgttagtattaaaatgtttcctcaagtcaaagtatagcatttgcttttcagttcaatcaaaggaaacagtaagaccattttggtgactacaaaatgtaaactactaattaagagatacaggtccaagttacagcctcttgttaatcaccgtcatcctccaggaaattcacagtaagcctttgcagacccacagcggtgcttccggttaaaagccagtgtggaatacatgtctcaagcttccctgatgttatttctgtacctgtcaaactagcaacttatttaaatatctgatacaacctccgagattcaacctcataaactttctctggtcacatcctcgctccctccttccctggggctctgagggcattttttgcctttacgccgttgcatcttgtccatccctttacaaatgctgagctcccagaggcaagactgtttcactgatatctgtgcagcagccttatagtagactgtcttcatccatcctggcagctgtaacaaaataccataaactgggcagtgtctaaacagcagaaatttatttctcacagttccagagggtgggaagcccaaggccaaggcaactcggtgtctggtgagggcgtgctatctcgctgcgtcctcacatggtggaaggggcaagggagctctcttgggccttttttattaaaaccctaatcctattcagaggcctccaccctcgtgatttaatcataccctaaggcccgaccccctaacactgtcaccttgtgggtaaggatttcaacagaggaatctaggagggacacaaacattcaaaccatagcccagactatgtgtagctgacgctgtgccagattgcgatattcactttgtgggttcaggggacaagaagacccagtgaaagcttgtagggaccttagggaccaaagccagtgacagtgtcagccccccgcccccaacgacttcatccacacctctgctcacagatgcctccctggcaccctctcaaaggccccaccctaattgctctctagccctcatcctgctcctccatcctatttcctgctcttcatcctgttttctctcttgcacgtttcactcctgccattgatttttctgtgtatgttttcagatgcccatcttctccactggcgtgtagttcagtgagtataggaactttgtttgacccaccactttgatcctgacatctagtgcaagagctgtggcatagtgtcctccataaattagcatttttaaatggatgaataaaagctgcactaccatactatactttggggccaatgcagacctaggttagggtcataatcttactctagaacttcctggaaaataagttaatacacatgccatttttaggttacaatgaaagctgcttctcatattgtgagtagccaaaatattctttaagacattattttttttgccctcgtttataaaagcctgctcacaagacctggaactgtgaacactgatttaattttttaaacagaaatgttgtaaacaatgaaagagaatcaaaaacaattaaaataatgcaatatgcagtttgacccaggagtttgatgctgtggtgaactatgatggcaccactgtactccagcctgggtgacagagcaagatcctaactgtaaaataataataaccataatgcaatatgcaattttacaccctatacttaatgcacagtaaatgggtctgaatgaattttcaaagtgaatacatagaccttattggcaactttatatgtgtcttctctattacttcagagggaagtactggtgcctgcggataaagttttagggagacagatttcaacttaacataaagaaaaagtcactaaagtcctaaccatcattgtatggatctcatcgtgtgtaatatatggacatacggtgaaggtggacatgccaaactctcgtcccaggagttctccaggcagaaactagaggaccagtgataggcacatttgtgtaggatccctttttggattattttggactcgatggactaaggtccttgccagtttaagagtctgtgattgttcttctctgatactgactcaatagagcaacttcagggcccattgcagcacccaggcagatccggcaccttctccaaagatccttctctctgctccatgcagtggtgctgatggtaataataaaaaaccgaatgcatggagagatactgaagtgcatcctgaataatcatcaaaattcattgcatgtatgaagtcaaaatttctatttgcaaactttgttgaattacccattttgaaaagttgatctttgtcagtccctcaagacaaagtcaattccattcttctccttagtggctattggtgaaaagtctgtttcttagttgtagatcaggaaacagtgctgcttgactagaggattcctcgccttacacaaagactgctgacacattttggtcaacagtaaaatacctattcatctcttccacccatatttcaaaagtagataacttattccttaaggaatgtttttgttgttgttgttgttgttttgtttgtttgtttgtttgtttgttttgagacagagtttcacttttgttgcctaggctggagtgcagtggcgagacctcggctcactgcaacctctgcctcccgggttcaagcgattctcctgcctcagcctcccaagtagctgggattacaggcatgtgccaccacacccagctaattttgtatttttagtagagacagggtttcaccgtgttggccaggctggtctcaaactcctgacctcaggtgatccacctgcctcagcctcccagagtgctgggattacaggtgggagccaccgtgcccatccaggaatgttatcttaatgcttagtaaaatgaattagaagaggtgggaagtatctactagctcctaacaaaagtttttactttagctatgaagacataaaaagaatcagtcccaaacttaattattgatgctaatgaggaggaaaaagatgagagaaaatcagctgcttccctggctgtgcatttctgcttcagcaattccttgttgtttaagagaaaggtggcaaacgcaggtgcccactgcagccagaaaggaatggaaatgagtgaacccctctttgtgtcatataacggaggccactggagagaacccccggtctctgacaggaaccgttgtgactcagctctggtcagtcattgccattcagaaattgttagattgccagttcttccagtatttcagcagaagtactaaatccatatttccatataaaaatatgatttttaaatgttgacaacccattacaatttgaaaaatatttcttttggcgaaatgaaacacctgcaggccacatctggtccgcaggtgaccagtgagtggtgttcacttgaatcaatataccagatggccaaagaggacttcttcctgtttctcagccttgcttacaagctactcacttggtcattaagaaatcaccaaagcttatgtagccagagggagccataacagaagtggatgtgcttaagtgtcaaggatccaacctggacactcagaaatccacaatactttttaaactgctctgtatgtaagactattttaaatctacctgtactgaattctgagctatgcaacagagttgagtaagacagcgttcatagtaatacatttctcccacttcagcacgcataaattgtcttccaagaaaagggatatttgtcacttattctaccagctgtcagtcagtcttcccttgatgttctgggaagctctttggcacctcagtgccttcgtcaccgacgtgagcatctgtccatgtgaggaaaagagaatgctgccacgacaggggttgtggtgactgttgaatctgcttttgctgcctcagtgttgaggaagccagggcccaggacttgcgcatggctagttaagagtggggtcaggactgcttcccgtgccccaactgccacactgctgtttctccaatgtcattcttctcattcatattctggttaattcagtagctggtcactgaggctttctgtgcttggcacacagcacgtggagaaggaacaggaaacaaacctgcaacattccctaagggaaaggtagaaaacaaagatcagggtcacacatttattctcacaaggcctgttggtttcatgagcaccagttttatagcttctcaaaccagggctagctcacatctaggtgagaaggtagcagatggtggttccagccactcatcccaccacacagaaacttatatcctagtgagtaactgcagaggaatcagtccagaagggaattacttcaccctacgtttcacaaacgcaaacccatgatcattacaagaatgggagctgcaactaatcataaggattgtgagcagttccaatcctgcacattccgagtttggcacagtgtatgagtttaataaatatttgaagccttcaaataggaacaaagagttttatggacacaaaatatgtcttaagtaactgttgagaaaagaaatgttggcttagctttagataaagtctctgtcttcctataccactctttatcttctagacattaaattgggtgtatattcttggtcaatatcccatattaaaaatgtactccctgaaaatattagcatgggtgacattttcctttgtaatcctgattccttggccagtttccttgttatcttcccaactgtctcctagctgaattgttcagtggttattattttacggactcatggagattcacaaggaggaagatgtccatttctccaccaacacccaaaggcttcttgagaacctcccagtgatgaaaatcgagagggtttctatgtgctagagctacaaatcaaacatggaacaacaaccttctcctcggcactgttgtccaacagcaacgacaaagcctaaatagggcagagaagggagagattcgaaaaatgaattagaaaaatctccttacaaagtgctttcttcaggaaatgtgggaccaaagaggcctgcagctttttctcttaatggagataaagtaggatcatccatgtgcttaaaatagtcacatgcagagaaaaatgagcagagacgtctggctaaatgttacatctgctttcactttcattaattttcttgcccagaagaaggtattagttaatgttagacagctgtcgaatgatacaccactttaaacacatttttaaagccactatttcatagtttgtagctgtaagtccatcagagtgagacaacatgaacatgaatatggagaacctagaaacacaacatagcatctatcatagtagacatcatctcctagcacatagtttaagctacgttgacaagaagtgtctgaagtttttattacttgcttctacttagaatggtaatataaactatttttaaatcagatgttacgggcatatgagatacataatctacactgaaatccaccccctcccagacacacacacacacacacacacacacttgaagacacccactggattttgaacatctcaatcagctcttccccattctcatcctctttcttatctgtttcttttccctcttcctcctccccttttcctcccttccccttcccttcccttctttattcttctgaccaattcagtctcaaagcctttagctgggtgaagacaggtgggcatctgcacagagaagtagccccgcatgggctgcctgagctcaagccaggaggtggaggcatctgcccgcctgggagcacctgggctgtggagtcagccctgggcaggaagagagggcgtctgcgcagaggggcagcctgtcgtgggaaatcagagcctaagagtaagggatgcgtctcttggaaaggatggcccactgggggtgtttaagcccaagcagagtgaggagggggtgtctcccagaaaggacggctggcaggggggtggtgtcgcagcccaagcagagtgaggagggggtgtctcccagaaaggacggctggcggggggggggtggtgtcggagcccaagtggagtgaggagggggtgtctcccagaaaggatgtcctgtgggggggtgtcagatcccaagcggagtgaggagaaggtgtctgcaaggagaggtagcagcgatggtgatgaaaatgtcttagactcaggagctagatcaagtaagaacagtaaagaagatgaaaacccagtttctccctgttggggatggaagtcacacatatggggaggtggaaactggaggcacacctgcgtggtgctggactggaactggggggagtggagtgagtccctgtctttctaaacgcagcgctgaactttcagctgaatcttcctgggactatttgcagaactcgaatggggtgtgaagattagcctgtaggagtgcgcctgtgtgaatttcctgaatgtaacggtaatgctgtggttctggaggagaacgccttattcgtgggagatacacagccccaagagcatttggggaagatggggcatcagctcagggattccttctcaaatgcttcagggggcaaagtcctttgccctgtacttgcagctttccttaagtttgaagttgctgtaaaatcttttttttttaattagataaaattttacaaaaatgaataaactgtgtgcctggcaaaggaattgagcgtgaaggtcactagcttcaggttggaaagtgctcttccctgtcaccaagcgtgcagccaccggcaaatgacaaagtcttgttctcaaaaacttaaaaagttttctaaagaaatagctgctaaagaaaatgagaagccagatagaaaaggcattgcctagtttattcttctccatttgagacattttcatcttctctaatatattccagcgggctacattaaacacctaagcagatagaatgtgtacatgttctagtaatcggtatatttatttcatgaaggtcattatgctagagtatgatcattatagttcaggcacaaaatctaaccatgtttcccctgggctctgacccatgcagatgtcagtatgcctccacaaggaccatcttccaggtaaacaggttacacttagctcagctttaagatggccataaatcttaaaatcgtggcatactgacttttgtttcagagtcaactctcagtagcctacacacctcagaatttgttttttagtttttcagccctactttcaattatttacagtgccctgaacatcaaatacagtctcggtctcgtacctttgtaagtcatgctatcatcaataatgcagataattgtattttgaaatgcctaattataattcacatttatatttatattattcaaacacccaatgcatttgccacatgctagacaataagaaaaacagaccaagaggctgagcgcagtggctcatgcctgtaatcccaacactctgggaggccgaggcaggtggatcgcttgagctcaagagtttgagaccagcctgggcaacatggcaaaaccatgtctctacaaaaaatacaaaaattagctggccatggtgtcatgcacccatagtcccagctgcttgagaggctgaggcagaaggattgcttgaacctgggaggtcgaggctgcagtgagctgtgattgtgccactgcaagccagcctaggcaacacagtgagaccctataagaaagaaaaaggaaaggagagaagagggggagaggaggagaggaggagaggaggagaggggaggggaatggtggggaggggagggaggagggagggaagaaggacagaaggagggaaggaaggaaggaaggaaaatggagagagggaggaagggaaaaagagaagaaaaacagaccaagatattagcaggaaagggactgaatttccaagcaaattgggagtcagtgcaagagtaatatcggctcaatggccaacaacaattagatggttttcagcagatgggggctagctggcatcatacgcaagagcatcagtctcagccagatgggaactttgaggttcctgtgattagcttggtaattctaagaggaactgcagaccacttgccataggtaagatgcttcctccatcctgctcaaagccctcccacccttcaccaccaccaaacaccatctctgctcctcatgtggaatctagggccctccacaattgaaagtcagccttccagaagtgcctcctgtgatgctggtgcacagacccctgggccctttctgtttgctgttcaagtctcgagactgcctgtgccctcccgcagctgtgctcttgccgctgccgttctcaccacccgatagctccttcccagactttcaggccgtcaaaatcctcaccttcctttaaaattctctggttcacatcagctttgtaagtatatcctgagcaagtattaagtgatcttgatgatttttttgagtcttccagctatgcctttgaacacgttttcctgtctctatctttttcatcttgaaaatccacattcgctgctgccttttttctgatcacctgttcggtccttacctcctttccatctggcttcctctgtctatcgattgctctcacaaggtctctgctcagccactaattgccacaagttccaggaagaggcagagccggggccaggccaggaggcagaagccactcgggggactggggggccatgccgggggcagtttggtccaacaaagaagcgcttgaaggaaaataatggaaaatcagttctgaaaggtagattgagataagtagagctgtataaacgttgtgacatagataattgtgaataatattccactgtctagccctagaacaatttgactgtccagtggaaaaaccttaccagcaaggtggtttcttgaagaaaaggaagtttgccacacagaaagctccaactggttctaagcaaagggtagcacctgcaccaagtatcagggcatgaacctgcctcctgggttgtcccggccttaatcgtacttcattttgatcagatggcttgcagggttgctgctcacagcctatttctactatctatacgtccacatttgaaagccacctccaagcacacaccgtgcacgccctgtggagaggaagcatttgcatttctacccctcagataactgctgctgcccagttcatgtttcaagtatgagttccttcattctatcaccaggcttaagatccctttggtagatgaactggatgtttacatccattattgctggacagccacagaaccgattctcgcagcatggctgtagttgtgaaccttctccaggattctctaccacggactctgttcttgcctctcaccgtccacgcccaggtgaccgtgtcatccccacggtgagtgggtgccctccttcaccctcagaagccaccctgccccaacgtcagccctgccttagaaaaaggaccacagacctctccatctggaaagacaaagagaccacacaggatgaatccacaccaatccacgaccagtcgtccactgtggagagctctccaggccacctgccaccaagggctttcaatagcagtcaggagccagatgcatgaggctcggagtggctttgatgagatcttcaatcaccggttgaccacacaggccacagtgctgtggtagagaccctccctactccaggggccactgatgtagggttacctagaatttaggcagagctgggtagaaatttaaaaaggggaaaaaaaactctttattgcaaaagttttagaaagggaggctgctgaaaggatgttgattcttcttaagaaaactttctgcacatcatctttgcatttttgtgctaatttctactgcaatttattttctcatcccagcaagtagcaatttcaggtgacgtgacagtttatgaatgttacaaacattatttctttttaaaaaaaatctcttgaaatcagacttggcaatccagatacattttcccattcagtatgagtgggagcattttattagccataatcaagttttccttttcatgacaagaaagcttacagagacctgggaaccactcatataccacggggtttctttgcaattcatgtaactgaggaatcaaacccacatctgcgcctcctctggccttacttattgtcagaaagttcctctcttgtcctgtcagttagagcaccagtaggaactgagctgtgtatagtcagctgctagcttgagattctgacaaatctttacaaaaatacataggcttctatggccctctccttcatcacaagttaaacccacatgaaataatgtattatgagactttgcaaagaagaatgcaattcatcttactgagaaagcaaaaccctgccaggttgatttctttctcagtagcttcgtgacaatttcaaggaagccactgtaccagcacttcatttccctaaaacaggttatgactcttctttccctcatgcgttcggctcagttcctgagtggctgccgtatgccaggcaacgaactgggtgcttgagatcgatgcttttgaggggcttgtgttggagggagagagaggtactcaggaggactgtccttcactgtgacaatgctgggacagagacatgctctggggcctggaggacccaaggaattccacatccatgtgccagggactttgttggaaccaacgataagtatgcatttgcatgaagaggcatcgtgctagacctggggagtgacagacacacatgaagtctctacccaacaaccgatcatggggtcataccattgggagcctggaagctgctggaagcccaggagctcaccatctcccttcccagtagcaaagccaccacccattttacagatgagaatattaagacactcgttacgtctcacgcgagggcacacagctgatcaggagctgagcccacacaagagccagagttcctcccacatccgcacaccccagggcctgtgaacagcgctctgccctctcctgtgcacagggaaacaccaacatttttgctgacacagtcccagaaatctcctccacagacctaagtgtgttgaaccctagtgacgtcctagacacaagagggcactgcagtactgcacatttgtgcttctcctcgcaggaccgtgatgggttctgcaagtgactggtaacttcccagggaatggtgttgcctccaacatgtaaaccacacaccacatcgccactgccacaactgacaatgtcaagactaccctgtggggacacagagaatcgagccctccagttcgagaagtctttctttgggacccaatatttggcagatgccaggcagaatgctgagtttgtggagatgaggacagaggccctgccctcaagtagcctgaagtctaggaaaatgaatcccattgggaaaccagtcaagggacccaagcttggggaagggactagcacgtgctgagacctctgctaagtggaggcatctcactcacgccatgcaagcagcctgggctccgatgcacacaggagcagtgcagaagagtgagggtcccggggtcccagtgccctgccagcatattgtcgtagagacaggcacacacagccagcaggaggacagtcaaaggcagaggatgggatggcaaggtgtttaagaaagaccataagggctgtaggaagccaagaaaaggagtgtttggtaactggtaaaaatggggtgtggggaggaaaaggcagacaacccctcatcgagaaggagcaagaagtgacttctgtgtgccttggctgcctcatctacaaatttgggatagtagtaccagccttgtacggctgacgaagtgtaaattatttattatctgaaacactcagagcaggacctgttgctggtagacggtggtgatgctggaggggatgctgacattgatgctgatgtcatccgtcattgtagctccgactctgactccgtatctcagaggtggggggctctggtcatttgcaccaatttcctgtcatatggggagaattcacctcttgtttccgatgcctggcaacataaattcacatagccaccagttaatagcagctgatgagtttccattctgtgcaaaaaattacactaaaatgaccaaagattctcatagacaaaggaaatttaaggacaaaggaaaattatgtggacaaaggagttttattttctttctgggtacaagagttggtggtggccttagcagaactggatatggaaggcctgggctaggcctggatggtcccggggctgcacggatgtagctcatcttcacgcagacaagaataaggacgcctgtcctctgagtactcactgcccagtgaggtcatcagcaccgtttccaaacagaaacaagatgaagaaacaactcaatgatgagttgtgccttgccagggtgggcggacactcagcctcccctagctcataagctagcatctgtctctgtctccctagaaatcccagctgccactgaggaatatttacactattaacaacagctcccagccgggtgcagtggctcactcctgtaatcccagcactttgggaggccgaggcaggcggatccccttaagtcaggagttcaagaccagcctagccaacatggtgaaacctcgtctctactaaatacaaaaaaaaaaaaaaattagccagttgtggtggtgcgtgcctgtaatcccagctactcaggaggctgaggcaggggaatcacttgaacccaggaggcggaggttgcagtgagctgagaccatgccattgcactccagcctgggtgacaaaagcaaaactccatctcaaagaaaaacaaaaacaaaaacaaaaacaaaaaaaaccagctcccatttatttcgctctaataatggccaagaactgcaaagagcatctatgtcacttaccttttagaaacgacactattgttcacatttcacatgtgagaagagggagactcggagactagggttgcacggtggtgagcagaagcgctaaagcgtaaagtgcaagaccttcactagaccctgcctcttccgctgctgtgggatcgtgatgttcacggcaaagaagtaaagttgaatgtattcattgcagaaatgattatcatttgtgggccagcgactggaagagccccttttctcttgatgtgatttggggccagttgtctacggtctgagaaagactctaggagacactgccgcagggcacccctgccctgcaaaggtttgttgtgatagtgactgcttctgtgccgtatttcgctggcttgggggtgtctgaaaatacagtctaagtatgatatgtaagggaaagggagaatgagaatgacttagacgtatagggtcagtgtgcaccaaatggagctcttctgacatcaccttagagcagtggaccctaagacctacctctagctcccttttgtgacttatttccccacaaaatgtgttaaagtcctaatgcccaggaaataggatcattgtagatgtaactaattaaagtgaggccatactggagtaggatggaccccggatctgatacgaggggtggccttccaagaagaggagaagagacagacacgggaggcagacgctgctgtgcgacgtcagaggcagggaaaggaaggacaagccgcggactgatggcccccaccagaagctgaaagagctgccgccctgcccccaccttcatctcggacttctggcctccagacctgtgagacaatctatttctgttgttttaagctgcccggtctgtgggaccttgttaggacagccttaggaaactgatccagtccccaggtacctactcctccaaatccttcttcaaccacctacaatcctctctgacttaaggccagctgacaaggagcttgctttaaatcactaccttggagcagtggaccccaaagtgttttggtggctggattttgttagagacacacattctcaggccccaatcacaaacccatggagtcagaaacacagggctggtgcccacccgtgtccactttaacaagccatccgggtgattcagatgcagttcagaggctgagagcccagagtgtacaaaatgcccattctttgcttccaagacacacttttcctattttcattttctgaaatcagaatgcctcttaggcaatctctgtaaaatcttatgattaataaatcagtggttcatcttacagctgggggtgtctcagaatcaatgaaaaggaaggaatacaacctccacctgatatgcctgtgagtgctgctttgtttaagaaagcggcttctgatggtggaaaggattcctgtgattttaaagcggtttgtgtcccagcagtgggccctgtaatgagcacctcaggcacactatgaccttcaggaatgttcctccgaggctcccaaaccttccgctcatttctgatgcaccaaagctggcctgaggcctaatctctgggtcccacttctgtttaattaccgcgagccttgtttctgctgcctgcctgcccgccgcctgccgcccggctttcagaagcatctctggttctggaggcttcacttcgaagatgcagccccttgcatggaggggaggcccctggctgggggaaatatgcatttggtcgacgtgttttcttctctctcttctgccagtattttcttctgaagcacacagcactgcctcacccatgcccaacccacctggggagctgagcctccagataaaaatagtgtgcagtttggaggctggtgtttttgagatcgaacagctgttctgtcgcactttcacaacacggttattaaagcaggagagaagtaattaaaattgtcacttgtgcggctgttcgaattatatttccacttcctctccacagagcattcattatgtgttacaaaaatatttcattgtggtgttttacatcattaattttgtttaaattattcttaattgctcactgacatgacaaaaaatgaggaggaaattgggaggaagagattttattttaacaacaaaaaaactggaaagggtgaattttatttattttgattttgatttcacctcttttcgagatgagtttcgctcttgtcacccaggctggagtgcaatggcgtgacctaagctcactgaaacgtccacctccccagttcaagtgatcctcctgcctcagcctcccaagtagctgggattacaggtgcctgccaccacgcccagctaatttttgtatttttagtagagacagggtttcatcatgttggccaggctggtctcgaactcctgacctcaggcgatctgccagcctcggcctcccaaagtgctgggattacaggagtgagccactgcacccagcctgaattttagtaatgagtcctgggctggtgtgggcatgtctgtggccaacatgcacgtacacatgcactcacacatgtgtgcttattcacacacctgcatgcacacacacacatgcatgcaggcacattcacacatgcatgcacacacatgcacacaaacacatgcatacacagatgcatgcatgcataacgcacattcacacatgcacacacatgcacacacacacgcatgcataaggcacattcacacatgcacacacatgcacacgcatgcaggcacattcacatgcatgcacacatgcacacaaacacatgcacacacatgcataacatgcacacatgcacacatgcatgcatacaggcacattcacacatgcacgcacacatgcatacatgcatgttcacacgtgtatgcatacagacacattcacgtgcatgcacgcacacacacgtgggatgtgcatttgggatgggctggaattgagcgcccaggagccacagttcatcccactgctgagccagctctgggggtgggggcaggtagagtgtgggtaccagcatgggagtatttttctgtccctgggccagtgacagaatttgtggcaatttctggtgggcgaggcgctcttccttgttactttttcctcagttggtcttgtatagtgtggccctttatcttctgaaagaatgagactttgtgttccgctttcaacttaaacctgacaaaatctctgtatttctttcacttccacagctggtatggagggaaaactaaaccacgtttactctattagtatgagtatcattgctcatttctttcctttccccagtattggtgaggttttctagaacaatgattagccaagacccaacatctgtgttcatttcttttttctcacttccttttctatcatttccatttcaaagcaaagaaaataagactcttatattcacattcccccaagcgatcttacatttttttaaaaattgttcatttagtttaaaaactgagtaggcagcgtctccacttgcagggcactccagggacccagcagccacgttaggatgcttctcgggtcctgaggtttggttggtggcactccgtgttcacgaggacaggaatacaaggagaaaacagtaagcataatgacagcagtaaaataattcttaaataattcatggaactaagagcttccagctagacgatgtcaggaatgtttttagattcacagaatgttagagcagaaagaagttccaagatccgctaatccaaatgttttcaaacttgttttaagccacagagccccttcttcaaaaggaaacttactgggaagcccaatatggaaatagcggcttctcaagagactctggggactcgctttgaagatctctgatcgggttccattgccacattttgcagattaaagaaatgtggggccaaaaaggttaagtaataagaaaagtctgcttgcaggaaataaaaacaaattgcaccaagagccaccgtggaatagcacagaacgtgtacgtggcttatgtaagtaggtatttgcaggggcttctgtgcaagatgcccaggaccgcagcgggatgccttcgggagcagagatgggatggaaaagccgggcagactctggaaggcagccagggtgctggcccctaaggacgcacgtgcaagaccggataacgggaggctttgtgtgtgcacctggagaacagaggtgcctccttataagtgacctccctggactttaaacatctcacaaaatgtggagccagttctcaggacaacagcacatctggttggccggtgggtccctcgaggaaaagaggatggaagactggcgcgcaggaatgccagtggctcatacctaagaacaagtgttaagaacagaccagttttcatcgtgaacagggtttcagtaaaagaatactcctgttgttggggcttcttatctttcttgaagggtcttccactaaccctcaccaaccaaccatctcaccatatgcccattcgtccacagagccccaggcaacagagtgaatggatgttaatagctccttgattaaatagtaataagaacaagaaatacagataagaatgcaaataataacaatactagacacacctactgaagggttaggagggcatggcacattctaagcatttgatgtgtgttactatgtgatgctcagaacagctctttaagatgagtggtggtatcattcccatttcacatatgaagaaactacagagcagctgattcaagtaacttgcccaagtctactgagctagctagtggtgcagccaacactgaacactcaggtttacttttactttgtgataaagacatagactcacacagggagcaaacggagcccagtggagcccagtagaggactgagtctgtggccaaagtgcctggcttccagtgctggcgttaccacttacagttctgtgcctgtttattcctctgtgaaatggggacgtagcgcctcttgcctggggctacgttaaggaatgaatgagtttgtgcatgtaatgcactgggacactgtggacatgatcagcggggcgggattgttaaccgttgttgttgccattactgttattacggtggtgccacagaggagggaggaggcagagagccatcacagagaagatgctggggctgaatcttgaacactatgtagaggtttagcaggaagactgggagggaagagcgggtgctcaggcaaagaacagcacagcccccacgcaggaacgaggagtccagaatgctgggccacagtgtgtgataggtcaggtctacagaggtcttgtatttcacgtcaagagtttaaacctaagcctctggacagtggaaataactggaggtcccagtcagaggagtgccacatcacaactctttgtaaaccctcgggcaggagagtgggggacagcgctgaggacattagcatggagatgggaggtatttagcaggcacagtgagaggaactaatgaggaatcaagggtggaggttaagagaggccagagcgtggaacgacttccattcaaaaaacggggtttgcttgcgctacatcctcgagtccaaaaagaaaagcaggtgattttgtatcacaggtagcgcccaccaagtgtctgaagctttatgggtcagcccacctggtcatccccattgcttgcaggtagtgacatctcccaccttacagatagctgagaatggaagtcgctaccctcaggacacacacccagcaggtggccatggcgaggtgccacccacattcctccattctgctgtcacacggtggaccaaccatcaggggctaaagaggaggatgggcagcaacctcagcctgcatgcagactgaggaatccacaggaagcggaagcctttccagtctcctcctcactacagtgacctgtcccgtgtccaggtctgatcagatgtgaaagcaaagatggactcccatgtactccatgctcactctgttgatgaaaaggagcctgagtttcccaacacaccataatttgtacacgcaagcgttgtctcgggaagctgagcatttattcccatgatgagcatgtgctcggaagtttttagatttcctcttgtaaaactgtttttacgttccagactcatacggaatatacaactttttacttcttagtatgcttaactgctggcagcgttacctaaacatgaattttatcataccttcattaccaaacttcatttcaatgatcttgtgcactttttcaaaagcaaagctaacctctaacacaggtagctggcgatttagaggctattctagagaatgcgccgccaactctgaactgactctgccaagtgttcaccttcccagggaatgtgcaccacccgcgagttatccacccattcatcctatcggcgactgtcaattggcgacttgctgttaacgagtcaatgtacgttttcctaggtgggatgcaaagttgtacaaaatagattcctatgttccaagtacagttgaagagataagacataactagatcactagaaatcaaatcagaacttaattgctcggatcgaaagtcattgcagaactttgagttacaacatggcagactgtgctcagtgctatgacaatctgagggcgagggtcataccaggagctgcgagaagtatgctgagaaggccgggaagtggggccagacactccatccacagtctagctgtgggctcagtcggggcgaacgaaacagccagtgggcgctgtacctttcccctgcaggcttttgcccacccctccaagcaggctttgcccctctgcaggctttgcccccctgtagcctttgcccccctgtagcctttgcccccctgcaggcttgcctcagcgcacaaaactgaaatactaagttccttctttcatacttggaattctgtgaatcatgtaaaacacctgaaaacgtcactccaaggggcataaaactgatgctgtgagttcaatgcagataattcctaacccctaaggcttttacaaatcaactacccaaaggtacgagctgaattttgggaatgtactgagaaccttctcttttcttcttttttttatgattgggaaggtttcccttattcaaaatgcctatcatgagccctgagtgtcactagtaatttctagagcaagaggttccctgtgactataaaaagtcaacgtgccattgcctccccatcttttgtgagcgtgtaaaacaacccatccatttccacggcccccctcgagccgcgctcctcggactgctgtatgggaaataggatcactttcaagttccctggacacataaaattggattgaagcaaaactaaatgctgtggggcacggagtggagggggtggggacagcctcaatcccaggtttgatgtcagcgataacaaggtttccaaatcaaacggcaacaaaacctgtcggcagtgttgactaggaaatgctgtcctcggaacaaatattttaattatccgcagtagttctggtagcttggctagctccctgtttattagtatgataatatcacctcaatgtataaactttatgcatcaggcatgcataatgcatgaacgggcaaataaagagatctggagcctgttcgcagcgggccatgccaattatctcgctcggccagagcctgcctctgctcacagctgttctttgaaaccattcaccaatgcttaagagatatcagtggtgccagccaggctgtttgaatctccattgtttacatactaggagtttagctgctggttggaaattatctgtcacataaacatcctctgaggatacagacgagaggaagggagacaagccctgtctttatgaattttttttatttattctgatgacttttttcttttacagttttgtgtcctttttaattacttcgttttcctctggaattgtcacatttctccctccagttgagcaggtgaaaactaatgctctaaaatgcctggggctgcaaaccagagacacagaaataaatattttctgttcacaagtctgttgtgtaattcaaagcttttcttttggtaatctgattttttttttatttttgtccctctggtcacaggatctttacagggcaaaaacgaccttatatgtgggttgtgaattcacttgcttccatttgtttattttcccttccaggaacaatataaattttgaaagtcagatattgaacttgagccaaaatagtgtgtgtcaccaaccaaagtttttaaagggccaaatgttgtttttattgcggttatctcttcgtaagcaaaggctgagcagataccatcagttttctgctatcagcaggcgtgccattgtatatttcagtttgaacatcagggctgttgttgcatgctccaaggctgcaccagccacgaggcaggcttatttatcaaggacttaggaaatatgaggaccaggcagagagaatcctagtgaacacgtttttgctgatgcatatgttcacgtgaatttgggaacacgcacataagagtgtgtcattagacaaatgcatagagaatcagatatctaatatttgacctgaaccaggaaggaactcacaatgaaatatgattgtatgctttcatttaaaagcgtatcctaaatacaaaaattagccaggcgtggtggcgcatgcctggagtcccagctacttggaaggttgaggtgggaggatcacttgagcccgggaagtagaggttgcagtgagcccagatagtgccaatgtactccagcctgggcaacagagcgagaccttgtcttaaataaataaatatataaataacagcatatcctatgttccaagactagacctaaacataaagataccagagatattggctgggaaaaaaacagaaaagcaatcccgtgttctcagcctcttttctttcttctttcctttccctcagacttagaccagaacctctttgtcggtacaggcagacaccatctgcttccatcctttcccatgaccatggcaaatgttgacattgcaaaggcagattctgaccacggaattctcatctctggaggaaggtatccccatcacagagagttgtgacgaggttgagagaatgtctctaagagccgagtgcagtaccaggcagatagtaggaaaaaaatgttggctgctgttgtttttgctgaagctgctgttgctcttactaaaagtagaccttagcaagcctgtatcctgcagttgagatccagataaggaaagctgcttacctggaatcacaaaatagctggtcccctgaccccttctttacttacaggagtccccgcatagacctctgaaccatggaccgcgtctggtggttgtactggccacatggcatcaaagcgtattttcatgcaagtctgtcttccgtactggactctgagctccctaagagtaaatgctttgtctatttctgtctgtttccccagcagctagcaccatgccttgcacatggtggcatctcaatacctatttgttgaattacatgcaaagtaaaaaagaaactatgaatatgaattgtcagaagaatagcagctaagtggagtcctaaggtttagccacaagaatctgtgccaaggcaatacagatggattgtcttacaggcatcagagacaaaagggcaaaagcttcctattgtatgaaacaaatcatttaataagttttactgaccagacttgcataagatcatttggaagaagaggaaaacaagtaaaaaaccaatgtggtaaaaacccctcataggtgtccttggtaaaagtattctctgttgtttcagataggtttaaagtgttcctcttgaatggtaccagcttccccaaaattctgtgtatgttcttcgtgtgttcggcatgtcccctcttctctagaaatcttaggtaaatgctaacatgggtctagtctggccaaagtagcacaaattttgagtatctgattcctaattaggattctgcttctgtttccttattaggagaaaatgtattttgatttagagaaattgtattttgatttagatgttttcctgaattatttgccagttttcaggggccatcacagaaaccttgaggcctgtggtggtcctacagttcacatagacagtagtgggcatgcatcccctgggccagagaaaccggatgcgaaggcggcctgcagagccgacctcagaccaccagagggtctgatctcagggcagagactcagttagactgcctgggattaggaatcaacagatacaaaattatacagaggagctgtttttcaacttttgtttagtggcctccttaaatgtaattttattcacgttctttgtattccactagtgtaaagaagtattctatattaaaatatcagtgaagatggcctggttgtcatatggcttcacaaacagaatataattccgatcttagacatggagactgctacccttggaacttagtgaaaagggcaggggattccctatgtacgaacagagagaccacagcctgaattagaaaaaccaggactccaagaatggtcttgagagacctttccttagcctgatttaaatttgccaccttgatatgtcatagccaattataagcttgggaggtcattcattcattaaccattaatctgttcgtcaaacatttttatacaacgctgagtccaaggttcagaacaggtggaggggatgagacatggcttcgtggcccaaggatttcagaatgtgtttgtctttctgtctgtgtgagatggggttggaacacggtcagagcagctatggctttaaaattgcaactcagtgtgacacttgctattattggtacttatggcactttcttcaatcacaaattagaaagcacacgggagaaatacctgcagcaacgtggtaagaaacaattagcttctaaataacataaaaaacagcaatgccattaaagtggacgaaggatgagagagggcagtttgtagtcaggaaaacctatgagaaatgcaaatgtcaagggggaagggaggagggatagcattaggagatatatgtaacgtaaatggcgagttgatgggtgcagcacaccaacatggcacatgtatacatatggaacaaacctgcacattgtgcacatgtaccctagaacttaaagtataataataaaaaagaaagatgtccagctttactcaaaatttctaaaaattcaaacatttacccattagagtggttttaaaaacttttttaagatacaacctagatctccatacactatcagttggagagcaactagacaatatttactaaaatgtgaactgtttcgactttcagtgtagaccgtattattgttccccatgtttcacagcccctccctgtaaaaagatcatcctccaccccatggccatgtggcctgcagggcctctgtggagatacagactcatccctgctctgttgggaccaatgggatgcgtcttggccaacagcatgacatggccatgtggcctgcagggcctctgtggagatacggactcatccctgctctgttgggaccaatgggatgagtctcggccaacagcatgagagtggacatgaactgcaccatgtccaggacattttttagttatgcaaattatttttggtaatatttatttttaatttattttttattgaggtaaaatatacatatataatgtatatataaatatatataaataaattatatgtatgtgtgggtatatatatataatttaccagttttaccattggagtggtaacaaatacatttatattcttttctcccccttcatcgtgcatttctgcaagccccccttgctcatttccttttgttgtgagctcagcctgttccagatgaaggctgacctttcaaccaggatcctagaaagaagacgcatcctggaggatagcccagcagagcacagccgggctgctgcagacctggttaccaggacgcaacattagcggaaagtcagcttccttgtttcacaccattgagagtcaggagttatgtgtttgaaaccacaagattatttcatgaacgttgactataaaacctttttgaaacagcaactgcagtgctaccaactagcttaacgacagatgcagtcttacccgtgtgcaaagatatatgtaagaggtttttcagcaacactgttttaagatagcagaaaatgaaaggaaacaacctaaatatccaccagtagacagacaatggactcaataaattattatatttccatatgatgggatactatgcatctcttcaaaaatgaagttttacaacttttaaaaattatttacatcattgtatattatagtattaacccttctgctactagatgttttcgcttaaccttataatcttcatgttggcccatgtcgataggtgtagatctactaattcattctgcatgctctataatattctgccatgtgagtaactgcgttttattcatttaatctcctgctaatgagtagctgagtaatttcccatttgtgacctgtacatagttgctgttaggaacaatcttctgcctgccttcttgtgcacaggtgcagaggatgctctgagatgtgttcccaggagtggagcccgcaggtcatacgcatgagcatcttcagatgtcatggatattgctaagctgttctccagagtggctgtgcccactgacacccccaacacggcttcaccctcttgtagtggccagactagatgtcaagaccgtaccaaatatgttacattgagacatgtcatatcatactatatatggcatgtatattattatgaatacatagccatgtggtagaaatatcttttaaatatgcagagaaatgatcaacattaacttcaaaatgatggtcacttctgggacgagagaggactgggattagggaaggaatgcaaatgacatcgtagctatttgttatgtcttgtttttttttgtactcaacactacttatttattattgttttccccatattcttttattttgtttggtttggggctctttcatttttattcatcattaataattgcatatatttattgggtacaatgtgatgttatatacatatatacattgtggaatgatcaaatcaggctaattaacatatctgtcacttcacgcatttatcattctttgtggtgaaaacatttaaaactccactcttttagcaattttgaaatatacaatgcattattattacctagagtcaccatgctgtacaatagacaccaaaaggtattcctcccgtctaactgaaactgtgtacccttcgaccgataactcccttttccccacctgccgccccctcacttcagcctctggtaaccatctttctactctttgtttctacgaaatcaacatttttagattccacatataagtgagatcatgtgacatttctcttcctatgcctggcttatttcacttagcgtaatgtcttccagattcatctgtgttgtcacaaatgacacaagtcctttcatctctaagactgagtagttctccactgtgtatatgtacctatgttttaatacattcatctgttgctgggcaggtaggctgtctccatgtctggactgttatgaatagtgctgcagtaaacatggaagtacagacagctcttcaacatcctgatttcaattcctttggatctttacacagcagtgagatggctgaatcatagggaaattctatttttagtttttttttgaggaaccaccatattgttttatgaaatagttttactaatttaccttccccccagagcatataaaggtttccttttctccacatgcttgccgacacttgttagcttttttttctttataatagccattctcacaggtgtgagatgatatcttattgtgcttttaatttgcatttccccagtgattagtgatgctgaatatttttcatgtatctattttctatttgcatgtcttctttgacaaattcaggtcctttgcccatttttaatagggttgtttgttttcttgctattgagtagtttgaattccttacatattttggttattagccccttatgtgatatatgatttgccagtattttcaacacaattcatgaaatgtcttttcactctattaattgctttctttgctatgcagaaatttaggatgatgcaatcccgttcacctagctttgcttttgttgcctgtgtctttggggtccaagccaagaatcattgcccagaccaatgtcatggagctttttcactatgttttcttccagtagttttacaatttcaggtcttacactgaagtctttaatcgattttgagttgattattgtataaggagtgagataagagtccagtttcctccttctgcatgtgaatagccagcttttccaacaccacttattgaagagactgtcctttccccagtgtgtgtccttggcatctttgtgaaaaataaattaactgtagatgaattggtttatttctgggctctctatcctattccattggttgatgtgtctgtttttatgttagtactatgctgttttgattactacatctttgtaatacgttttgaaatcaggcggtgtgatgcctcctgttttattctttttgaacaagattgctttggctatttggggtctttgtggttgcatatgaattttaggatttttctgtgaaaaaaatcaatttccttctgtttctatgaagaatgactgaaatttggatagagattgcattgaatctacaaatcacttttggtagtatggacattttaacaatattagttcttccaatccatgaacaagggatatctttccatttatttgtgtcgtctccaattttctttcatcaatttttatagtattcagtatacatattttttacttccttgaatttattcctaagtatctttttcttgatgccattgtaaatgggattgtttccttaatttacttgtagatagttcattgttagtatacagaaacactgctgatttttgtgttgcattgtgtaacctgcagctttactgaatttgtccatcagttctaacattcctttggtgcaatctttatggttctctttacagaagatcatgtcatcagcaaacagaaaaattaacttcttcctttactatttggatgacttttatctcattttcttgcctaattgctcttgctaagactcccaggactatgttgaataaaagtggtgagagtgggcatccttgtctttctctgatcttagaggaaaagctttcagcttcaccatggattttgatgttagctatgggtttggcatagatggcctttattgtattgaggaacattccttctatacctacttgttgacagcttttatcatgaaaggatgttgaagcatttgtcaaatgctttttctgcatctattgcaaggattgcatggccttcattttgttaatatggtgaatcacatttactgatttgtgtatattgaaccatccttgcatcccacagctgaatcccacttgtttatgatgaatgatcctttttaaaaaaattgtttatttccataggttttggaggaatcagtggtatttggttacatgagtaagttatttagtggtgatttgtgagattttggtgcacccatcacccaagcagtatacactgaacccaatttgtagtcttttatccctcaccccctcctcccctttcctccaagtccccaaagtccattgtatcattttcatgcctttgtatcctcatacttagctcccacttatgagtgagaacatacgatgtttggttttccaattagtgatccttttaatgtaccattgaatatgatttgccagtattttgttgaggatttttgcatttatgttcatcaggcatattagactgtagttggggtttttggcgggggtgggggagtttggtagtctctttgtctggctttggtatcagggtaaggctggcctcataaaatgagtttggaagtactccctcacgttccattttttggaagagtttgagaaggactggtattagttcttctctaaatgttggtaggattcagcagtgaagccatcaggtcctgggcttttctttgataggagactttttattattgattcaatcttcttactcattattgatctcttcaatttcttcatgattcggtcttggtagattatatgtttttaggaatttatccatttcttcttggttatccaatttgttgccatgtaattgttcatagtagtcgcttaagatcctttgtacttctgtgttatcagctgtaacatctctttcatttctgattttatttgcatcttctctctttttttcttagtctggctaaatttttgccaatgttgtttagcctttcaaaaaacaaactttagaaaaactaacttaaaatagagcaatacggtgtgtaatgttaagattttgtaaagcttgcagatatacatgcaaccattttcatgttatttttgtctatgtttaaaatacgtgcttatgtgtaaatatgaccatgtatgtgcagacaaacatttaagaacattttagcaacatttaggttacttctgggaagtggggataaaatagatcactgttactttattcctttctttagtgtcttttagaaacatatattaagtttatgaattaaaagattaaaagcgactaattcaggctcagtagcttttttattgtatggatgagacaaaagacttaaaactatctacacctgtggtttttttcctctgtaaaatatggttagaaatatctactttgcagagctgctgtgaggatttgattagaaattattcataaaaatatctaacagcatgccttttacttagtaggcactaaataaataataattgtttacattattaataagaacataagagatattctgttttcaaatttattcaccctgaaatgtgcagagaaaatacttataggttctttatttttcaataactgattctttcttctacttgagctccccatgggggggaaatgaatcttagagccaagaaacttagtttgactcaataatttaaactggcatttaaatctcttttggtaagtgctgcctctttgggtataaatatgtggactttcagatcgctgttccctcactgggtagggggtgccatatttagcaaataaaaatttaagatactcagttacatttgaattttaggtaaaccacagataatttttttgtagtatgtcccaaatactgcatgggacacacttacagtaagaaaatacttattctttatctgagcaccacatagaaccaggcatcctgcatatcatctggcagccccatctgtgggtgaacagagaggggcaccacgttggggaaaagggccctggactcctggactttgtgcatggggtagagactggatccagtccttgggcaacagataggcctcttctctgatgtccaaggccagcatgacccacagtctgtgtgtctcagctcatctggacctgtggatgggcactggccagaccttccaccttacctctcaagggtagaggactccttgcatttctgccacatgctctttgggccctggactagggtgtccactctggggcctctgcagtgaggccctgaagccctcagcatggtgggatcatagcagattccctagctttcaaccagttgtcagacggcccctcagaagcgtgtggggagttttgatgatgaccgcaggaatactgaactccacccatccccctgcccaagatagtgtgcatgcttcagctttgctgtggccaccccttgtgagtccatggcatcctgggtccatagcctgaagcagagcgcaagcagcagccctggccacagtgttcccacagtgcatctgtctccctgggaccacccacttcccacttcctctttctccctgcatcttcccacaatccacctgagccaaagggacaggctctcctggctctcctgcctctcctgcctctcctgcctctcctccctctcctccctctcctccctctcctgcctttcctgcctctcctgcatgctctgtgctttctcattcagcattcactccacaaacatccaatcgagcacaactctattcaaaacacccttctcaatgcagaaaacaacagcagtgaatctgacacattcttgactgtctcggagcttacatcctagtgcagtagatgaggagaaggacagcaagcaagtatgctgatcattacatattataaggtcccaatagcgtagtgtgtggtaatgagttctacaaagatcaggaaagctgtgagaatggaggctgaccacatggtcatggaggggagttcctttagatgggatagttggagatggcatttgagtagacatttaaatgaaggaaacacaggccatggcagtgtctaggggcagagcatttcaggcagtgagaacaagcggctcagtgggaacaagcctgacatgcctccagccctgcaggaaggccagctagctggagccggtgagtgcagaggacagtggctaaagtaaggttggaaaagtcaccaggcctgcctcttaatgttttcaaaaagatatagaaaataattcagggagactttttttctttctttctggactctccttttgctaagaagaatcgagaagtcacctgcagagaaaacagatcaggggccacctggtcctgagttggaccttccttctcacttctcagggctgcaacattcctgcagctgggaagctgccagctagtgattcaaggaaaaactgaaatatagtttgacattttcaaaatattcctgttacatgaatacgtttttacaaggtgttatgagagacccattggatggagtgacatccttcctggaggagccagcagacttagcactgaggcttgagtaatttataagaacccataaagccatcctggaatgtgtgtctgtatggtaaaaatgatgttatgaggatataaaccaaatgtaatgcttcatagaatgatgttttatggcattacaataatctgaaaatatggactttgagttgggtgtgttgcagttaacacaggtgcagaggtagggagctgtgccttggcccccctgccggcctggcctctgccatcccatcattgattactcttgcatgaattcgggttctccaggctccgcacgtctatctacgtggcataagaaaagcctgttttcttgttctcggctaaactaatggcttcgtttttgttttcttcctggctattctctacccaacacaggtcctggtgttcctatggtgacggtgcacaacacaacagataagaaaagtaagtgctcttttttttccttaaatcttcctgagactcaggagaaaggaagcaaaacactctatgagatcagctggcccacattctcctactcagagacagagggatgagtcatgtcctagcagttcagaataggccatgctgatcaccaatatcaacgaaatatgatgaaagtcaaagtccgcatacccctgccagagggccccacaccccttcacaagtgctgagcctggagggtcattccaggcctacccaggtcatagactgacatcctctgaacagccagctcaaaaggctttgtagcctcacatgagtccgtccccactgagaacctgccatgtggcaccaagacttgaggggcacatggaggctcatctgtctttgtgggtctgggagcttcacggcatggagggtctctgcatccatgctgcacaggatatcagagaaaaacttattctgccatttgtaaaatggtagggaaggctttttcaggactgttgtgaaaggggagggagattcaggctcaactttgaatacagcaagatcccgtgggggtttatagccagtgaccagagaaaggggtccgtggatggaaaactgctaagagaaggcatcagtgggaggcgatttttgctaagctgacctcacaagatccttgctgaaggcaggacaaggacttaggctcaaaggtggaggacgaggaacagttacggagggtgatcagatatcaggggtggagacctcttgctaaagctgggcaatgcaggccgaagacaggttaggatcaaggttgaagcctggtcaagaagaggactcagaggagcctcactcaagtttggtcaaggagagtctttgaaagacttcccagggtcactagaggtggcatgtgtttgcttggagggaccccacacaggttgccacgggcacatccgtgtttacgcgagggatgtgtgctgtgtgcagtgggaggcagaggcacagcacagctgagaagcaaagagaactcgccctcggtccctccctttccagccctccctctgtctaacccaaagcagcctgtgtcctccttcccccgaatccttcccactcccttccacattcaggaaccccttccctggcaggagggcaaacttcatggcccgggtccgcagttcccctaggtctggggacagaggtgactccgtgtctccagtgaccatcgagcatcagcggctccctgattcctatctctgtggtggtacttcaagctccaggagaactggaggcggcggcggtgaggcgcatgttggaaaggaggctccaaacgtgtgtttagacaccgtgaagtggtcaaactgttccaaagtgggcaaaatagattcgtttaaagagacagcacttagccaataatcccaaataatgatgatagtctgccaagctatcaaatcattattagaaatacaaaaccaaagcataagtaatcataaaaccagaaataaattaatagattttaaagcccccacaaaaagccataaagtggatgtcagaatggatatacaaaaacactcagaatggccgttggagggaccccgtgctgagaagaagcgggatggccttcctgtgctcctccccagaggaggggctggtttccccagcaaaaaggttcacctgctcccaggctgctttccagcctcacctgcgaggtttgggaatctgggccatttgagcaatgggggcggtatccccggaaggatgttgggcgcgattgcctgggtctctcacctccccactgcatccacccaccctctgcccactctaaggggcacgaggctgtgaagggccctccaggaggccgcagaggccaagctagaacttccaccaaggcctggggtcggtggagtctgacagacatactccggcatgacagtgaatgtttgaaacacctgtgctagacctctttaggtggaattttccctgaaaaaatgccgatgttgcatagagcctcaactgtgacatcttttttttccttaagcaaatgtatattttcattttgagtatttgataagatttagagtccatggacacctttctggtatttgtgaggttttccccttcttgaaaattgatggtctggtagaaattagataaggtgtccaatggagctcacagcattgcagcctcccgggttagctgttgcccgatggttctgtgagatgccaccactgaagacccggaagtggagacacaggactctatgcactatttgtgcaacttcctaggaatctataattatttcaaatttaaaagttttttctaatctgtggtctaataaaaaacacaaaagtatctttcagctttgaaaaatatgatatagcatatggctcttcttacaaaagtcattcccttaaatgctttttacttctttggaggaagctattattaatctattcaagttcaaaggttaatatagtccctacttttgggaaatgcattttgacttctaagccacttccagcctggatgtgatcagtccttggggctcctaaagcctcccacggtgctggatcaagtcaacacagtttccaaggctcatgtgtgagtgaaaatgaagccggcctgtatcttaggtgtgtgtgacactgttgagaaaatatttcatttattccatttataaaaataaggtaatctataggtgggctgaggtgcaattcttcggaagagagtcccagtaagaattgaccaaatgtcttccagcaagtgcaacatgctaatatgctcaaagatccaggaaattttgttaactctgctgggaaacaaaacaaccacttcttttcctctgtaggactggctactacattaaccaatcaatccaatcaatattgacagaccataggccctaggttgccatccatatccgttgcggagctgcataaatgggaattttttaggaagcatttcgccgtttgcagttgagctgtcactttggtgactgtgactccctgaagcaaagagatgggacccagcggcttaagaaataaaaagcactgtgcacacaggatggggctggcgttacatgcctgtactcccttcttctctgtgtgaaatttaacagtgaacctgaaggtgacaccattgcgcttgatctcagcaaagtgctgactaattggaaactggacggcgtttagaattattttggtcacatttattttacgagcctatttatatagcagtgtttgactctgggtttcctggagcctaattcaaactctaggaatatttcatcccgccctagcctgtttctgcatttctggctgtcaatgtagttcaagctctttcaggatggtaacttaagctgccattttaacttggaaaaaaaaatgattaaatgtggttgagttgattgtcgttcccatccccaggaggacagtaggggtcccatcttgctcagtgtctatgttacattcagacttcatgatttgaggggttccaggttcctgaacacccactttttccccatgcctggataaaagtgcctgaaatcccttccttgcacggccatccctgagggttggcacatcatagctgcacgaatggctttgagtccacctgggaaataagagtgagtgtggcagggcctggtaaagtgccaaacccagccctgagttccagcctccaggtgtttgccatgggaggcgtgtggggtttcttcagtgtgtttaccttttgatatgtctgatgtcctcttgcagcacttcacagcccatctccaacccagctgtgtcttccccaaacaaaatgcactgagttttcattttgtctgtcaaactggtgcatcttggatgagaaggcaggtgcctggtgcttccaggcccccagttccagcagcatcttgttcgtggtgtggttggaccacatcagagcctcctcgtggcctctgcagtggatgaagggtccacagcatgtggtttgcggggggatgtgcatatcaggcagccgacaaagccattgtcaggccagcacttcacacatcagcctttgggcctcaggtaagcttgagatcagttgtcctctttcacgattgaaaaggccgctgaagacttccaggagcaacacaaaggcaggcagtgagtcacccatccctgcagatgcctgtttcatccaaacactcagccagctagcggttctgcatcgtcaggattctgcaaaaccccacaccacttgtacttgttccatttgatgctccatcctgaacaactcagacaaccgtgttctgatcagggggccagagaaaggctggaggtcacagggagccatggtagtaacaatagtggccccaaccagcatttatcagcacttgctccggggcagggtgctgtggcaaatacttgacatattttaactcatttcatcctctcaacagcctgtgaggcaggaactgctattatccccacttgtcagctaaggaagctgaggcaccacagcttaggtgatcgggccacatgcatgcagcgaggaagcaaaagcagaggagttgcatctcggacgcaagcagtgcggctccaacagagcctgttcttccagacatgtggtcattgcatggcgctgctcagccgcctgccctcatgcggtctgaaggacaactgcaaatccagagcgatgcccggcctgcactcccattgagatgagtctggggaggcagaagcagtcacacctgcagctcgttctcagcaccttctccgcccatacaccacccccggggtccatccgagccagctctggggtgagcgtgcggcacggcaccttctcctgctctgagaagccttccacgtcacagggaagagatgctcctcaggccctggtggctgttaaacctgtgggagccccgtcgaattaagggctctgcttcctgcagcagctcagcctccatgtgcaggctggggtcatactccatgcactgtgagagctcagcccttgaacttcaccctctaatggcagccccttagcccccaggcagcagtctttggctagccatccattattctcttttgaatgtaatcgtagcagcagttctgggctctccacacagcaccaggccccttccttgtaccaaccctatgaggttcaacaattcatctgagatccacagcaaacttcagggcgaggcccggactcttgtcttatctgactaccaagcaggcgctcttgactgtgggctgggggctgataccagatgtctgacaaggggggaaaggcagccccagaccccaagacccaggatctcctggccttcacgtcgctgccatctgggaaatgtgctcacagcagcagcctctgtgaccactgagctgctggtcaaaaatcacccctggtttagatcagccctggtgaggccatgccagcacaggcatttgcacctcacgcctctgttgaacagtgtgcaaagcagcagcgcttccaacccgcgctgtggggctgagccaggaaagcggggcccatggcctacagctgggcagggcaagacaggaggcctcggggagccggctcctgagccgctgtgtgacgccatgactggcagctgaggtgtggcccacgttctgttacagggcagagcctcggcactgtgcgtcagctagcaaagggggctctggaaggctgggacccgtctttatcatactatcctctcccagccctgctgtgaaatttgaaattactgtttcagaattctttgtcctttcccctcctctcccccactgaccccaaaaccaccctgggaatatttgacttttttcctctttagaaaatcttatctacaaacagagcctgcggggtgttcacagatgtgactctgaattatttaaaagctgtttccttaagaaggtaattatggttgggaccaacctatactcatttggtgcctggatattcaaacaaacaacttaggtactgggataaaaaaaccaacaaaatcatagtgaatacattgcgggctttaatgtaaatatgaaaggcaggcccacttagagacgtggatgccaactcgacgtgtgggagtcgaaattgcggtgtggcttgcaatgcagccccacagccatgcagagaaagcgtgcgtgtggcggggttgaagctggctacactggctgacagcaccccacagcggcctgcaagcgcatgtgggagcttgggatcactaggcagcctggttcccactcctttatggcatcaaaagttaggtttctctacctcctactctcttcatttgggtctttgtaagaaagcaaaaacagcccctaccaccagtggtgcccaggtgggtccatgaagcaacgccagatgcagttggtttccagcctctgttcctgcaccagtgctgctgggcgcacccctgccccaccttctccctgaggcaccccctcctagactgtcaaggctgtgcccacagctccccttccatcaagcacagggcgcccacacatggagagacatcaggagcatggcattccagagggcccacatgtcactgtcacgctacacgccaaggagtttgcccgccatcctgcaggacccaggaggagcactgtcagacgtccctctcgaaaagcttctggtcgctgtgcagagaatggatggaaggaccccaggttgcagacaggagggctgctgggggccatggtggaaaggatgagagtctggaccagcaggggggcctccaatgaggggctgcctctgcaggccctgcagggagagatgcacctggaaaggggccgaagagctgccatctcaatccagtccagggaggtgtggcacttgctggggtggcgaagcatcatacagaatcctacagcctgtggccctcaaaacctgggtcttgtccagtcctaacaaagaaggaacagccccgctgcctccttgggtgcagcagcaggcgactgggtgggtgtctggagagtaggtcctcatgcctctcaccctgcaggccaactgggcaaagccctggctctcagaaacagtggccaggacacagcgggcagctgccccatcacagccgtggagccaccaccaaggttggggccgtccagcaaatgcacaaacccatttcagacctggagataaaagccagctctttcctgcagatcatatggggcagaaccaaaaagactaaaaatgtaaaaagatgatgaaggaaagtaaatgttaaaagaaaaaaaatttcgaaagcagcctggtgcctaacttcagccctaggtcttaacatggctgcatcaggcaagtttctacctaagacccacagctttcaaatattttaaggagcaatttggtggccaaagagagaaagtctcattataaagtggcctttatgtgaggggaccttgccaagtcatgccaagacagaggacactgggccatctgtcctcaagtagtttttgctcatgaatccctaagataatttttgaaaaatcatgtttcccctacacatttttaagttgtcacctaaagtttttctcattaattcaaagctgtacaaaataagtttttagcatatttattttaaaataaaagtattacataatcctatgatatctaagtattgtggcaatttgatacttaccactgcccagttaaacatttctggaacaagttcttcttagctttacatccttccttttcctcctcgagctgatatttacattccatttgtccgcccgtcaccccagaattctgtcctaacgtcatttaatcttggaaatattttaaaggtcttttctttttaacttccggtgaccataaggccataatcattacttgttggatggaattattatcataattatcacttgttcacatcaagcaattaggatacattacatactttgataattgttggacataaaaagttatgattgctctgagatgcatctcttagcgagctgggtgtggtggtttttcactcagttcatgagcacacctgactcatttccagagaagaccttgtcagaaacgtgtgcgctcctggtttttccctccttttggtggtcgcttctttttgtttctgtagaatgtctgaaaatgtgttcatgtaaataaatggagagagaggagtcttgttatagcagtgccattttcactgaacgcctgagctatatgccaaaacattgtggcccatccattctctgtcattaaggattattttcaatgatctattgatttttagctcagtgagattccccttccattttgttaaaatcaaaggatgacaagccgaccatgttactgggggctcttacccattactgggggagttctcttactgaactcagccttggtggtccctcatccttcatgtggagcccacctgtgtacaagatgccccagggacagatgagggggctccaaggccttccttgccctcgtgacgcctgtgtcaggccatgatgaaagaggcacaggaaaggagcagttccttggagcgaatcaggcatgtccattctcagcacatttgccagcaggctcctatggatgcagagagcctgggaaccagtctcctgaatcccacgtgtctgcactcgaaatcttctggacccacagggttgcacgcgtgagcagctgtcctggtgggtggagtgtctgcagatttgctgttggaacgtgttagacttcagtccagcatttgggtgggcaagctggcatttggctaacacagagtggaaagcaagccacgcatggagctgcacgccctgcaggatgtctgcaggtgcttcttcctctctactacctaatgcgggaggagagctgggcttcgctgccacccagcagctctcggtgcctcgaggagcacctgcaggctgggcactgtgccagccactgcacccgctcatccgtgggctggaggacacacacatgagtcccctcaatgcacaactcctctggcatcaaacacctgccatgggcccagcatgatgctagaaggaccaaaaataaatgccacctactgggaccctgccctcaagttgcttaaaatctggctggaggaaaaaagatatggcaaaaagaataatagttgcccaaactgtgtcagactgactctaacaactcaacattcggagttcagagaaaagaggctgggtgctgtggctcacacctgtaatcccacgaaggtgggaggacctctttttcttttttgacctcctgggctcaagcaatcctcccacctcagccccacaagtagctgggactacagacatgcatcaccatgactggctaatttttacatttttctttggagagatcaggtctccctatgttgcccaggctggtctcggactcctggactcaagtgatcctcctcccttggcctcccaaagcattgggattacagacgtgagccaccgcacccgaaccctttcctttgtcttttctattttgttcataaagcatgtctctgttgatcactgcatgtatatgtggagggaaggacaatatgattttaagaaatgtaatatttagcatcttggccccaagattctacaatcctttcataggatttttttttttttttgagatgggggtcttgctctgtcacctaggctcaaggggagtggtgcaatcacagctcaagctatcctcccactgcagcctcgacctccagagctcaagctgtcctcccacctcagcctcctgagtaactgggaccacaggtgtgtgccaccatgcctggatttttttatgtttatattttgtagagatggagttgggattacaggtgtgagccactgcacccagcaaggaagatctcttgagtccaggagtttgagactagcctgggaaacacaatgagaccctacctctgcaaaaattacaaaatttagccgggcatggtggtgtatgcctgtagtcccagctgctcaggaggctaaggtgggaggattgcttgagcccgggtgttcgaggctgcagtgagttatgatttcaccactgcactccaacctggctgcaagaccctgtctcaaaaaacaaaaatggagctcagagaaaagagatttccagttaaggtgagtaagtttaaacagtagtcatgcgggctctgggcctgaatctggtcttcgaatatgactaatggcctagccctggggtaagcggacggcagctgcaagagcacagggagggggcgaggtggggcagagaggggtcctactgatggccgcaggggaaggtgcacgtgaggagtgagcagaaatacagcaggagaggcctggactagaaaggcacagaaaacccaggcaggggaagtcaggccaaggcaacagggagatgccggagagacttctgcctaagcctctgcgtgcacacaccatcctgcagttttatttcttgtagaaatgtgagaaagggaagcggctgctctctcctcttttagatccgttgcctattggtgttcattggatctggtcaccaattttccaaaatttagcacagtggtgattccatcaatcccctgaacctgccgggccacttggaagcatgtcttgcaacagtgcacagctacaccacgacctgcccatgggacgcagcgagggaagcagcctcatgagcaggcctgagtctctgcggtctcactgtgtccagatctgataatagctaattccaccaaatattagagggggctcacatttaattaaagagtggccatttgtgtgctccagactggaggtccccactgccctgaagtcaaaagaaaagtccttcagggaatatgccaatcttttcttatttctctgctgagctcctgccctctttgaatgcaattatgggaacaaataaaatggcttaactcaagtcccctgtgggacagtcagctctctgctgataaaaccagttgtgtgggcaatcattaaatgagaaatctaatatttaactaaatttaatagtctgttgctttggtgctttcctgtgaagggtgggatttcaatagagaggaacgaggtattcacacgcagcctgtgtagtccatgagcgattagaacatggtgcgttcccacatgaaaccagaactctcagatccggaaactggtaacgggctgtttggtggccagcctgtgttccgttagctctaggcaagcttaactcagtaggcagcagagaacattgctccctgagtttaaccttctccttcatgaccagcatttgagatcgcacactgacggctgaaacatcaaattcacatgcatatatatggagacaagagcgtactttaaccagctgtaagagggtctgtccccattttctctcagtttgagatttggccatccagacaggctcttgccactagcagacccccccagctgaagccctttctgggacccagaagcagaagctaactgatagcaagaagcccatctctgttctcattggtagggtctttctacctttgctcctgccagttcccctgatcttcatcggttgtcacttccatcatttgacccacatttgcacaccccaagttcctcacctgttttgcacctgggatgatcatgtcagcaggcagaggagcagagaccacaggttctccaagggttacagctgaggcgtcgagatgacctcatgagatcgaggcactggtctcctacaataagctggagtttggagcgtgtggatgaactgcctcatagtcccagagtcgagtgaattaacttaggtgcatcattagtctcctaaacatcagaaaattttccatcaacttctaaacaccagaaacttttccatcaacttctaaacaccagaaacttttccatcaatttctaaacaccagaaacttttccatcaatttaatgcagtttgctttgggtcctcgggtctgagctgtgtgggaaacactggttgatagtctggcctcagtttttccaactcttaccgttcaagagatctgagccctgaagacctttgcagcttcctgagacactcaggaggacctctcctcggtcctgtttagtttcctggggccacatgggaacaaggagaaagacttgggtagaaacccagactcgttaccatctaaagatgcttaatttccaagatatgaatcgattttccacaaacccatctaccccgggtacccaaaactagtgcatttcgtctctgggataggactgaacactgataccttggcgaggggtagggagaaggatttgctgccaggaaaatgaccaaaactttcatttggtgttaagtgtatccagagagcttgacaggtgcctgagatagggtggtcaggtccctcttggaggaggtaacgcttgcgttgatggaggagaaggagctagcaaggaagatttcaaacacagggcagcacgtgcaaaggccctggggcagcaaagagcttgggaaatgctgttctcttcattaccaggcagcactccctgctagtcttcctttcctgtaactgtgaatagaacatgaatgatatgcagtcactgtctcataaaccaactcctctcacctgagtgtgtgcctggagcattgcattaaagggctgagggcatttggactcagcaccaatgagtgctgccgcccatccattaggaacatgggctgaggctgtgaagctggcgcaggggcatgcaggccccttggggtggagtgcacctcccctaactcacgtgcatgcctgtgagggagagtgcgccacctctgcagccaagtctctgggtctcagagttaaggtcaagtctacttggacttcccttggacttcaccactgcagacaccccttgcagacgtagctgtgtttcctgctgggacacgtgtcctgcaagggacacgtttctcgcatgctacgtggtgttcggaacctttcccagtggtggtctaacgtcagatttgttaaaactctacctgtttgaaaactagtgtcactatttctccccttattttttatcaaagctcaatattcaaatgtgtccagcaacttgcaagtcattttcattttatgtactcgtcacaagcgctgggagcttccatttccccctgttcctctacagaaggttgccaggccttctgggcagagttcttgaataaagccacagccccatgttctccacacaaagccacacgtccagattctcctagttatgggcggtcatttgacctccagctgccccggagaagcgcccacctgcagagcagctttttttttttttttcaagggagttatatgggaggatgactggacatccattctagcattgtttgtgatcatttgtttacgctttaaacaaatgcacaaattgcagctgcttccaagtgatttgacgagccaaaggcaaagttccttgcagaaaaattccctttcacaatgaaccacaagttatccccatgtgtaggcttagtgtgagaagggagaaaggaagttgggtggtttttatgacacgtcagatggtgaaatgaaacagaatggccatttcagtacatgaacggagagttcctcaggggacttctttgcatctgaagaaatagataacgaggacgtgtgtgtgctgtcgcggcagaggcacaaaggtccagcgcatccacaccacagggcagaactgaccttggtctctaccacggagggaggacagccagtcccactgcagtgtgaagcaaggctcacacgactccactgtccacaaatacagtcaccgaagttaaggtctctccagagaccagcttatcttctgttttgggagagagatcagaatccattttatttctgggaacatttaataaagatgataccctagtttctacccacctttccttttctggttattatggccacaatttttggaaaaccatttgtcctaacagatgtgtaatgtaggttttcttaaaaccagcagtcatgggaagaatcataccaaaacctgtgcgtgtgacgccacggagaacaaaaacctctggtgggggaaggagaaagcctaagacggtggggagaatctttaatccacccaaattccagatttgagtctaggcttttgagcgcataacttgagcgtgttttttaatgcccagtttctttttctgtacactagaaataataataatcacctctgaggctgatgaaagcagcagttacgcacatgaaaagccatggcccgcagaggtcctccatgagtgaccactgcatctcagtgtgtccctgtttcctctctttcagaaatgtttgacctagaaacaaatgaacatgtcaagaaggccataaatgaccgacagatgcctaaagtggaatacagggacattgagattgatgattacagtaagtactacgtttttcccctctaaaagaaaaagaaaaagaaaacgtgggctgtgacacagtgcagtcatcagcagcaggtgccctgcaaggaagactccccaagcacgggggtgtatctttgcccctcagctcctctggcatggagtgtcttgtgttcagaaccaagatgctcactctggtgacaaaaccaaaaaaagcagggcacaggatctctctccctgagaggctgacagttgcttcaaagcaagaccacagactccaacgctctccttctttggtgaccgtgtcaagacaccgtccagaaaaacctcttccctctggaaattccctttctgtgccatctgaagtccttcctgcctcatcagctggtggattatgggctgatgaggggcgtccttgcagccagggtttacgtgaggaggtttgagtgctgttactccctaggaaatgcttctcactctgcctttctctgcctgtgcccttctttccttgaactgtccctccagtcattcggtaagttctcctgggcactaactctgtgctaggcgttgctaagcactaaacaccccagagcattagctggacctggactcacagctctaggagggaggcagagcctcggagcctcaactcccacctccgcacagatggctcccaagtcacccggctggccccgtgtcctcactgcccaccaggtcgttactcttggaaacccaagtgtaaaatgcccacagcggatttcactgtcttcccccagaactctgtcccgctccagacttccccacctctatgcatagcagccttttggtggtaagttggtgtcgaataactgagacttcaaaccttgaagctgtctttgagtcattcatgcagacaccacttacccatcacctctgaggctgtaaacgggtttccctcctgtgcaaactccgactgactgatagtaactgcaggagctctttgttgaaagggaaggtttccagagctcggcggaaagcgtgttgaggctgataagtaacactgagctgaaagggcagggggaggagccacacaccttgcgtttgccatccctagaccgtctctggaacctctttgtctgcccttccctgacacgagacagcagcgtgtcgcctggagcctagggtattcgctggcagcccccttgtgctcagcagcttagaggagacacaatcacctaacagactcagctcccaagagcaggtaccaaggctcaccccacgaaacaaaaacaggtcccccaaacagtacgtgctgcaaagctgcattgcgtagagcagaaagtaaatagcacgagaattcagagaagagcatgagactgggctggggacatgtgggaatgctcacggaacgtgggacttgaacatggtccctagagtcagcatcaggtgggctcacaagaggagaccgtgcaatccagagaagagggcaacgtgaggggtcttaggcaagggcaagtgcagtgcagtgtggctgggtctggaggctgccctggagtcccagcctgcaggacagcccaggtgtgggccctgcacagggaccctcactcgcctgtgctcaccacgccctccctgcagcccaccacaggtccgggccaaaaacttctggccccgccatttggccacaggaagctatgctctatcacaacttttctggacattgcattcacctctgaaagtcagaacattctggaattttgatgcacttcagatccgctcccgcccccacccccacccccacccctgcccccaacacactcacatgtccaaaggctgtctctcttaaaataccctgaaggtgaccacgccagggaagggggcatgaacgaaatgagtagggaatggtctaggagaaaaagaataattttgtgtgtgtctgtgtgtgagacagagtctcactctgtcccccaggctagaatgcagtggtacgatcttgggttactgcagccttgacctcccgagctcaagtgatcctcccacctcagcctcctgagtagctgggaccacaggcaggccacatgcccaactaattcttttttttttttttttttcgtagagacagggtctcactatgttgcccaaactggtcttgaactacggggctcaagcaatcctgcctcagtcccccaaagtgccaggattataggtgtcagccatcatgcccagcctagaggaggaagaagagaaattcaagaaaaccataaacaagggctgggcatggtggcttatgcctggattcccattactttgggaagctgaggagggcagatcacttgaggtcaggagttcaagacaagcctggccaacatggtaaaaccccatctctacaaaaaaatacaaaaattagccaggcgtgatggcatgtgcctgtagtcccagttacttgggaggctgaggcacgagaatcacttgaacctagaaggcagaggttgcagtgagccaagatcgcaccactgcactccagccttggcaatagagtgagactttgtctcaaaaaacaaaaaacaaacaaacaaacaaaaaatggaggctgtgacaagctgctttggccaagaaatgtgtgtattggccagtcacggtggctcacgcctgtaatcccagcactttgggaggccgaggcatgcggatcacttgaggtcaggagttcaagaccagcctggccaacatggtgaaactctgtctctactaaaaatacaaaagttagctgggtgtggtggtgcacacttgtaatcccagctactggggtggctgaggcaggagaatcacttgaacccaggaggcggaagttgcagtgagctgagatcgcactactgtactccagcatgggtgacagaatgagactccatctcaaaaaaaaaaaaaaaaaaaaaaatgtgtgtgttatcccagcccaatggagaaaccattgccccggcatgtctctgaagctcctctgttctcagctcgaggctcctccgcagccttggcggccagactgtcaccctggcaagatccctttctgagctccttaggcctggcctcctcctcctccagcccactctacccactgctgtcccagtaacgcttcccaagcctgcagcactggtgtgtgactgtcatcccttcctcttaggaaatgcagaaaagacctttcaaagcacaaagccagctttcccacccttgccacacactctgtccagcagggggtttccttaaaaggtgggtgggtacagatgccaggagaggatgtggggcacctgtatgagcccagcatcaggaagacccccttagggatcgcaggaaatctgaaagatgtcagccctaccgacctgacttggttttgtttttttactttatgctaccagaggctaatgcttttctttattttattttattttgtattttttagaaaagtaggacatcttccagaagggctcccctgaaatgttttcagccagtcagaacatggtttccaaggtctgcccttgggcttatcagtggcagggagcagcccagaccatgttttatggaatttaaatgatgaagtccaaggcctgcctctccgccagtccctgggccattgagctaatttgcaagccattaacattcagcccgaatcagtaatgagacgccaggtcagagctggctgcccagccagccacccaagcctgcagtgtatctgtgtagtaattgtattgaaaagccgctaattccaatttaattgctgtgcctttggtaatctgggttgtagttaacatcaacaaataaattcaacttggatgggaagatttgttggaaggtagggggcacagaagaaattggtgaggcaggtttttgaggtttggttcctacccactctccctcacccactggatttcatgctgctgaggaccagatccagtgaccttggtagccacgggatccaatgggctgtaccatccttccctggcttcccctagctgtggctgcagcatagccatagagccacccagcacaaacctgccaacagcaagacccacagatccacctggctctgcacagaggcactgccatgggccggcaccctctcccctctaggcggccccctgtctcccctgaccctctatctcttcctctccctgcctccctgctcccaaatatccatccccagcatccccgatcagatgctgagagatgcctttgttgccgcaggcagccctcctgctctcagggcaccatatttccctgcctgaaattctgctgctagcgagtgcccgggccatcgagtcttccgtgcattcagtgcactcccatatgcaagactgaatggaagcttcagagaaatgaagcttcacacaggtcgggtgacttgcccaaggccgcgcagcaggccagagtcctcaggatgaaaaccctgggccagtctctgtctgtgggcttcccctcaggccccacccagagcaccctcacccccacggtcacccaagggcatgcccgataccccgtggccagcattgccccctaacccgtgctgtgctctgcttctccccagacctgcccatgcagatactgaagccagcaaccttcaccgacaccacccactaccctctgctcctggtggtgtaagtatcgtcacatctgtctttccctggtgctcgttctggggctccgtgacacccatgataaaggaatattgaactcttaagaaaagataagcaggagaaatgacattgttgcaaactgaaaacataacatcgtttagcccaatgtcaggttctttaggaatcttggagacacccagaggttaaaggaaagtgggtgctgtgtacccaccgcctctccccaggctgcctcaggttctgtgaccataaagtgaggctgctgggatcatcgtagtggcattttgcatgacaggctcaccggaggctggcaggggacaggtcccaagacacagagacacaagatggctggagcctgggacccgcaccctgagcccgtgggtctcactggctggcatttctggccactgccgtgaatgcccttttttcaccagcaaagaattttttcagctctttcttatattcattaataaagcctccggtttgggttttgagaacaactttttgtgctctgtaaatgccttgaaggtgttgggtctgattagggaactcagtgctaggagccggcccagtgccctgtgcataggttcaaatgttgcctgacagccctgagtctaggtgatgtccacgcgctgacaccgcacggggaggcagtgcagagggggccacctggaccgttgagcaaatgccccaatgcacctcctggtctgtactttcaagaccacggagcaggagaaactcctgcacccctcgtagcctgggagagccggctgaagcgaggcctatgctgggctgtgttaaggatgccagtgcaactaccccctgagtaaacgctggcacctgatggagctctgattaaccctggtgtcttgccctgctcccttcctgagggctgagtccctaaatagcaaaaaggttccattatagaaacgccccagggcacagattccaatagctgattccgttttgcaattaacccactttccttaatatctggactgctttcacactttcccagcagccatgcatgcacactcacccacatgcagacacacgcacccacacacaggcacacgcacatgcacacacacccacatgtgcacacatgcatccacacacacacatgcacacacgcatacataaacacacacatatgcatacccacatgcacacacacccacaggcacacacatgcacacacacgcacccacacacataggcacacacacatgcacacacccacatgtgcacacatgcacacacacacgcacctgcatacataagcacacacatgcatacccacatgcacacatacacacacatgcacacacatacgtgtgcatacgcatccacatgcagcacatatgcacatgtatgtgtatatacacatgcacacatgcacacatctatacacacccacacccacagacccacacaccccacacatgtgcacacacaccacacacgtttcctgcctcctttctcttactaaaccagattttccccactttctccaggatgctaacaacttccgaaccagctttcttcccctgcacactggtttcttcagtgatcttaaaggaaatccccaaaagcatttcagtttacaaaacaattctccttcccttcagaggtaaaagtggtcgtgcccggtggagacagctgagctctgctgagctcggacgggaccggccaggcaaccccaccccctgggtgcacactcactctggccttgctagcttgccttggaggctgtgtctttttgtttgtttctcactgtgacatcaaatgtgatagcaaggagatctggagtccctgagcccctgcttcagattaaaaaaatccaaaagaaaacaaaggcacactcgacatagagcagcaccatgactcaccaggaccctaagcatgcagcactcgagcgcgccgctcctggcccgctcctcctgcccccaccccactcctcagcccttggcagacagctgggagagtgcccgtggtcgaagcagtcacctggctggagccactctcagttggggcactgctccctgctgttccagggaggcaggctggacctggggctgactttctctcctgtccatctttttcccggcaagagggaaaatcacttaaaaacttccccacacccataagtatgctggtcaatgaggaacaaccagtcctgcatagaaaatggccctgttcccagcctgggcaacatagcaagaccccatctctacagattaacagatttttcttttaattagccaggcatggtggcacatgcctgtggtctcagctatttggaaggcaaaagtgggaggattgcttgagccccagaggtcaagcctgcagtgaaccaagattgtgccactgcactccagcctggccgacagagtgagaccctgtctcaaacaaaagaaaaaaaaagaagaaaagaaaagaaagagagagagagaaggaaagaaggaggggagggagggaggaagggagggaacagccctgtttgaggaaaaagaaaacagccctgtttgtggcactggtcgaatcccatggtccaaatgccccaccatggatgcctttcagccagcagtgctgggctcgcaaatgaagagctgggaggagagcacagtgggagccgccagcccaggtcggaggccacactgcccagagccaatggctccttgactcccgagcagagggagggagaaaggccacccatatggcgggtttgctgttacttccgacttaacaagagacagaccacgtcttcaagccagggatgtggctagagtcagcgcggccttgtcacttgtgatgggtactgagaggtacagcctgggacatctagaacccaggaaagagaaaccttcttgccgtgtagggaaggtccccgcagggagaaggtgggaggatttgtattgtttccctcaccaaatagatgctttttggtggccgtcccagacagcgccggtgtgtgtagggatggccctgggtgtcctaggctcttggaggtctcctcttcctcctcactttatggggtgtggataacacctggctcacctgcccggggcaacagaatctggggtatggagttgagcgtgtggcagccgggtcacgggtaaaatcccttacgggggtcatctgacgtggcagctgctagaccagccgccacccaccacgcagcaggcctgctgagcccgggattctctttccagggatggcaccccaggcagccagagtgtggctgagaagttcgaggtgagctgggagacggtgatggtgagcagccacggcgcggtggtggtaaagtgtgacggccgtggcagcggcttccaagggaccaagctcctgcacgaagtgaggcggcggctgggcttgctggaggagaaggaccagatggaggccgtgcggtgagcacccgcccaggaagcaggagaggccgggaggggacggggctcctcatgggggcagcaccgcagtcacagtgcgggaatgctttttctccacgcacacatttttcatgcaatttgctcttacctaaaatctcttggccattccaaagaagtttcaaaggaaacttaggaatcttctcctagggacatttataactagttttcccactgcagggtagattgttgagttgactaaaacaaggggatagaaattgccggttgggttggcttggcttttctgcgctgtggtcactgacccgggccagtgtccacgcatgtctttgccatttatcccaaggggaggagagaagagatcaggaaggaaggacagaaaaagggaaggaatatgaatggggctggatccgtggaaatgggtcaccctcgttactgagagcaggacctccatgcacatccaggtggggccagaatgcccttcccggctctgaggaagggcaggcttttgttctgtcattcctgtgcatccctatcactgactcagcaagagcaaccgacatcacagaaacaaaaggaggcttagcaccaaggggcagatgctccaaatgacttattgaatcttattgttgcactggaaataaaaagacatcaagacactgcgccaggctgcagctggccttcaggctcattttgtagaagcagttttcacagtctgatggcacagaggactgcagcacttactctaacttcaccccttagagatgctgcaggaacagctcaacggactgtggacttgggttctgagaatgacaagaaggcagggagaagcgcatctaccagggacccccgccgcgaccatgatcatcaccgttatgggcaggggagcgtgaggctgggcccgggcacacaaggagggtggagcacagagcccagctcagtacatgtttattgactggacctggcatctctgtacctattataccagggtgctttgtgcgtttggaaatttttactcaactgactttgaaaacatttctcctcattttgaaaaagattgacggccctggtatgtactcagcgaatggtctttcaatggaaaacaatgagcgtgtgaatgaatggttccggtcctcctccagggagctatgagctgggtgatggcagacaaagcaattgcttcagaaacccgtgttgcagctgggaaatacggagcgggagagctctcaggactcagatactcagggaaggagtgtctgccaggatgcctttgcctggaagtcaatgactacaacaacacatgtgtgcgtgcacacacacacacacacacacacacacctctcaaataaggaactatattggctacaaaagacacagggatgtcaggtctcaaggttgatgaatccagacaccaacaatgtcaccaacgacccaggctctctccgtctctccgcccagccagccatgatggtctcatcctaagccgagccctcagtcacggggtggccctcagtagcacctggctccatgcttcgtcatctacctccagcaggttggggaggaaaccacttttagaaacttccagaaaggaaaggaaagtctccccacaagcagacagcaaacctctccttccatctccctggccctcccctgcccattccagaacctgccaccagtgagacaggtgcaggcagcccccccagagaccaagtgggtccgtctgacaccagtgtggggccagcccctgagcagaggatgtggggtgacaagggaatgctggggttcagtgtggaaggaggatgggtgggtggctgctgggtcagcagcgggcagtgccagccacagaggactcccaggacacggaagccggcccaggctgcgctctggagtggagtgggcctggcttcctgggtgggggcacgagtgctctcctggcttcccagacctcctcctttgggtctttttcatttgtgtgtggcttcccctgccatctcctgctctttcctcaccccacctgctctatctcctcccagggagatttggaagcccggggcctccccgccatcaagggcaggcccaggggaaagtcgcagcaccctcaggctccccttcgacacttggctctgcctggcatcttccccaaagagcacaggaattagagggcaaaggtgtttcacacacacacacgtcgtgccctaaaaagaaggaatgggcccaaccatctgttccaaaacaaggcagaacctgttctggaaaaagtcaataatgccaactcctaaaccaccgaagctcaaagaatgggagcgtgtggacaacggcaaagcttagagccgttgccaaagcacagactttcttaggaagctgatgcccaatggcgccaagccatagaaagcctccctcagctctccctaggaacgaggtctgcattttcattcatcagaaagaaatagcccaatttgatcggaaacctaaaatcaggaggctgacacattagcctgactcctcccactcccacagttcccccgtccaccaccaccatatcctcaccgaggagcccacaggccagcctcccacgagcagctgagatgagctgtggaagggagctcgtcccacccctgtggaaggcagcgggcagctgtgtaaacccgactagggccggtgggctcctgtctcctagagacaggttgtctctgggctcaacttgggattttcttcacgattgtttcttttgggtcctacgtgctcatgtgtacacacacagacaccctgggtcatgtgctaaggagcagcagaaatgcctcatttttatttactcatttgttcacgtagctagtggaggaagccaaaatagttatccccaaaatattgagacctgctaagtgaaagatactgaaaacacagggactctctgcctctgcccctgtttgccagacgccaggacatccatccttccttcctggggacagcacctgctcatcagcccagagagggtcccagccgttgccagggtctctgggggcagattgcattgccttctcacaggttccctccttttaaaagactgggggctgggcatggtggctcacgcctgtaatcccagcactttgggaggcccaggtgggcggatcaccggagtccaggagttcaatcaagaccagctggccaacatggtgaaaccccgtctctattaaaaacacaaaaatcggccgggcgcggtggctcacgcctgtaatcccagcactttgggaggccgaggcgggcggatcacgaggtcaggagatcgagaccatcctggctaacacggtgaaaccccgtctctactaaaaaaaaaaaaaaatacaaaaaattagccgggcgaggtggcgggcacctgtagtcccagctactcgggaggctgaggcaggagaatggcgtgaaccccagggggcggagcctgcagtgagccgagattgtgccactgcactccagcctgggcgacagcgagactccgtctcaaaaaaaaaaaaaaaaaaaaaacacaaaaatcagccaggtgtaatcccagctactcaggaggttgaggcaggaggatcgcttgaacctgggaggcagaggttgcggtgagccacgatcacgccactgcactccagcctgggcaatgagccaaactccatctcaaaaagaaaaccgtaaataaataaaagactggagctgctctctcctttgcctggtcactatgctgagagttatggctctttgttaaaatactgtgtaaacagggcccctacaccactgccttaagaggcactggaactgaggcctccgccacgtggagggcacagcgcacgccaggaaatctcttccggttttcctcttgttcatctgactttcattttcaggacagtgacagtgtctcgaccaggaactcataagggttgagaaaagaaattatattttctcctctttactagaaaatgtctaaaaatatctctaactccacacttgacattatggcttggcttgaggtaaaatccagacagacaataatttccatctaacaagcaacaagcccacagcctgcaggcgtcctgctgctggttgaggtccagaaaccggaaggaccccagccacttcgtgggggaagcagaagaccacaatgcggggcaaggtcccagcaagggtgaggcagggacccaggcagcactggcccagagcactgaggcccagagcaccaagcggctgctgccaaggctgggccgtagcaggaagctcatgggaagaatccctctgtggccaaacaggtacaagacaggggcctcctcccaggaattgggaacagaaggctgtgcaggtgggatggggtctcactggcttgactctgagcccagaagcatagaaccagagctccacagattcctgccgacccctaaggctcatcccagagcccgcgtgcttggagtcacaggctctgggtgggggcccaatagcagcagatggaccccatgcaacaggggctgcgtctcccagaaggggctctgcggctgtggattaatggctcgcagtcgagaagcttctatacctggaagtgctacagagttattgcaagggtgctttgaggttttaacgtgaacatgctgacttggcactaaataaataaaagcaataaataattatattggaatgctaaggttgctttttatttgaagaggggttttcatccttgaaatggatggaaaacatggctctgggctacaggaagacaaagtggcagcaggatgtgcactgaaccctctttcccctcctcgacctcacaggacgatgctgaaggagcagtacattgacaggacgcgcgtggccgtgtttgggaaggtgagtctgcgccaccctggtctgaaaacccctcagttccagtgtggcctgcaccattacccacgtctaatcctgatttattgagaacgtctgtggtctgctggtgagcaagtaattttttaaaatcaagagcctgggtgcttagtgattccagccgtgggaggtttcatttgatcagctcattttcctaagtttctttttacattatctggaaggaaagagaagggaagccaagtccccgcaggagagctctaatacattcctaatgacttttctcccatccatctgctgtagctcttggcatggtagccaggaaagaagcaaagcaggaatctatttctggataactcgatgtggagtaacaacgttaattaccatgtctacttagacggaagcacaggtgtggggagggtcgcgcagtgaactctcaaaccagagccgctcccatctggtggcccttgtcagaaggctgtagcctgggacagctcagctgtagctgaggcccacggtttggagttaggtctctgcaccgccacctactatggccctggtacatggcccctcattctccttagcctagacctggggcctcttgatctcaagaaggccagcacacagatgggtcggtatagacccatcttccctctgggagtgaccctcagcacaggccctgcagaggaggccttgctgtgacacccccgcaggtgaaggcttggacaagtaatcagcacagtgcctcttacgtcatcgcctccaaaacctcagagcccagcatgcactggagacccggccctgccctgtgggctgctcccggaagcaggggatgcaggagccctcccacacctcctccttacctgccggaggtgaagtggtcaggaggagggccggcggcttctctccttgttcagagcccgggcacagagccctagaggtgcattccaggtgcctagatgtccactcactgcctgtgaggcccgaagccactgggtcattggtaggtgtaacttgggtgtcaatagccatcacctctccccaccctcatggaagtgacttcccagcagactggcagctgaaaggcagggagcctgggccgtggtcagtcttttccagtcgtcactctgccccaaatgcacatggatgccactcctgagggcttggcctccttcctgtgccttgcatatagtccatccactcagggcctttcatagttcacttctggacacagagaggctttctcaacaggcagttggtccagaagcacaggcagccgaggtgccaaagggaaaggggaccctgtgcacctgtcagagcacaactgatgcacccccacaccctgtacccccgcactcagctccgccgaggacatctgtctgagctccgtgctggggatctttcctttgccattctgcccagtggatcccgggcgtctttccagagcataagcatctctgttttgttttaacaagccttagatagaggtccgtagaccccacaatggtatttctcctctgaagaataaagcgtcaatccttttagtggcttggcatgttgcggcctgtccattctgtttcctcctcgcatgtgccccagtgatctggctgcagcctttgtcaggcatcgcaggacctgggacacagagcccaggggagcagcagccaccctgcacccagaggtgacctggagagcaagggggcacctgtgcgttatgttctgcagtttcccccccgacaccgaaaatcccccctgcagaagattgcctgtctctcatttaaaccagagcaggccgcgtggccctgcaggaaaatgagatttaaagaaaacgaagaatgacaagtaaggacgtgtggagttcactgacaataaatattatttgtcagaaaatgaaaatcttctttcattgtcattagacaaggtgcccctgccctattaaaggaacacaccggaacgatcgtgcaggtcataaatggttgatcttggagtttggcatgacctgcgcttcacggtctcagtcaggtacctgggttctctacactccatgctcccaacacgcatgctcacagactcacatacacatggatgctcacccatacacatgctcacacacacatgctcacacattcacacacatgctcacccatacacctgctcacccatacacatgctctcacatacatgtgctcacacatacacacacatgctcacccatacacatgctcacacattcacacacatacacaaatgctcacatacacgctcacacatacacacacatgctcacccacacaatgctcacacattcacacacgctcacccatacacctgctctcacacacatgctcacacatacacacacatgctcacccatacacctgctcacacatacacatggtgtcacacacacgctcatacacacacatgctcacacacacgattacatacacctgctcacacacacacacatgctcacccatacacatgctcacacacacgctcacattcacacacatgctcacccatacacttgttcacacatacacatgctctcacacatgctcagacacatgctcacccatacacatgctcacacacgctcacacattcacacacacctgctcacacatacacatacatgctcacccatacacctgctcacacacacatgctcacccataaacatgctcacacacacacatgctcatacacgtttacccatacacatgctcacacgattacatacacctgctcacacacacacgtgctcacaaattacatacacatgctcacacatacatgctcacaaacacgactacatacacctactcacacacacatgctcacacaattacatacaccgactcacgcacacatgctcacacaattacatacacctgctcacccatacacacatgctcacatgattacacatgctcccacatacatacatgctcacacacattacatacacatgctcacacacgctcacacatacacacgagtacatacacgctgacacatgctcacacacacgattacatacacatgctcacacatacacatgctcacccacacacacgctcacacatacactcacacacacctgctcacacatacccatacatgctcacccatacacatgctcacacacacatgctcacccatacacatgctcacacacatgctcacccatacacatgctcacacacacatgctcatacacgtttacccatacacatgctcacacacgattacatacacctcccacatacacgattacatgcacctgctcacacacacacatgctcacaaattacatacacatgctcacacatacacatacatgctcacaaacatgattacatacacctactcacacacacatgctcacacaattacatacgcctactcacacacacatgctcacacaaattacatacacctgctcatacacacacacatgctcacacgattacatacacatgctcccacatgctcacctatacacatgctcacatacacacgagtacatacacatgctgacacatgctcacacacacgattacatacacatgctcacacacattcacattcacatgttcacgcacacatgctcacatgctcacccatacatacacacgattacatacacatgctcatacatacacgattacatacacatgctcacacaggctcatacacatgctcttacccatacatgctcacacacacacatgctcacacacaagcacacatgatcacacaggcacacatgatcacacatacacaggcttgcacaagtttacacacatactcatacatgctcacacaggcatacacacatgctcacatatgcacacactctcacatgtataggcacacacaggattacacatgctcacacatgtgcttatacacatacacccatgcacatgttcacacgtttatacacacatatcacacacacacacccccatatactcacacacacgctgccacatgctctgtctctcacacatacctgacagttccgtgctgtcccgtttccctcggggtcttcccttcggaggctgcagctcgtctgagcatccagccttgaaggcactgagcaggcaaggaggtagggcttttctctggggaggcctgcgttgcagtacggcttcctcatccccaccaagggcagggaagggcaggagtctaggacttacctgaatacagaacacctgggagcgtctgtctcgtgtcggccttgtgctgagcatgtgcagaccaggacttgcgccctaagccacttgttggcccctccctcagaatcatgtgcagtggcttggcctcacccacagacaagggaggcggtaagaaatgccataaagagacgctgagcctgaaggacagcaccttacacctgtgcagtccacacttgcctttccaattcgccgttgcatttcatcctcacgtcccttgacaccaaggcccagaagcggagaaggcgcacgtcgcataatgctgagttggaagggagtttgcttttcatctcttgttactgccccgtgaacaactttccaagtgacacattttgtaaaaggagagaacctgcatggaactggctgctctggggctgtctccctgcccgaggctgcttcatgctgagttactgccaggactcctaactgtcttctctctgcgctttctccaggattacggtggctacctgagcacctacatcctcccagcaaagggagaaaatcaaggccagacattcacctgcggctctgctctctctccaataacagacttcaaactctatggtaaatagccctgcaggaccaagcgacgggctctgctcccgccccgccccgccccctgcctgcgtggccccacagccctcccttcagcaccaccgtcccgctaaccacaggtgcctccaggccacagtcaccaccttgggctgatggaagaacccggggaaggagagggaagggtctcaggtaatatgttttgaatgaaagtggtcaatccccagatgcctacaaatcacatcccaatgaagaccacgagttggaaacagctagtactccgctggcagcagtgggggcgaggaagccagggtgcgcaggaggggagcaggtgccacaggccctgccgggccgccctccttctctgctcccagaagaatccgagcagggccctgccctgagttctatgcctgggcatgggtatttggtgcacaggtgttaccagataaggaagggatggttgggagggaattgctaccatagagcaattcaacgaggtccacgtggctcagctctgccttcccatctccctggccatgcaaatggcacctggtcagcacctgtcctcagagagtatggctctccatgagcacaaggcagagatggggtcaggctgtcagggtgacctgctgtggggatcagatggagatgagcccacccaggtgtgggaaccagacctctgtccaggcacagaagggctttgctgtgtttgggggttccaggctcctgcattctcctccttatggtcacccaaccctttttctctgaacctgagctctgtgacctgaacccatttcttagaatatacagagaggtcttttctgtggctccgagaacttgaattcaggtcagggctccgtggcagccaggctgttccctccagctgtccccaccctaagcagcgctggcaagtgaggtggaaatggagggggcttcctgctgctggtccaccgcagtcctgccagagcctgacattccctgcaggttggaggaacgagtccagcccccattgccacacctagccctagccctgctgtgctggccgagccctgtagacaccgcccagcaaggcagggaccacggtgggcccagcagcctcctggctggtgcagccaagtctcccaacaccttcacagcgggctcactccagtgcaaattttaactcgtacaggaactctcctggtccaaaatgtgaatcatgtaagaggaatcttccctcaggaatgcgggtgccaccttcaaattgagtgagactttcttaattctttcatcatgctgtttcagatttgtctgattcaaatgcacataaatctgaatcagattgtctgattcaaatgcacacaaaagctgccatcatgtcttgatgggtcactgtgcccaaaaccagccagtcctcttcattgtctcctgggcgccctcaggcttaccctgcaggccaggggcactgtgcagagccctttcggccctcagccctgggagaagcccctgacactcttctgtcacccagctgaccgcagggcctcaggcagaaccaagagcagggatgtgcctggactttttaaaaaataagtaaatcttgatggaaatgtgctctcttaccacccatgcccttcctaagtgttgaaggaggaggttatcctacttatttaggaatcagattaactgggttttgcttaattaaggttctgcgatgctgatgaaaattgcaacaccggcactcacacacattaaggttcccgttgtaccgcctgatgccccttgtaaagacccaaatgatttaggtggtgtttttaaaaaaccaacaatctgccacacaagtggcaagtgggaatgagcctgagtcctcaccccgcacccggtccagggccctccctagagtttgggggctgcgctcacagggcctcgaagccagaggtaacctccctccctttgcttccgtgcagcctctgcgttttccgagaggtacttgggcctccatggacttgacaacagagcatacgaggtgtgtatgggcacaactagagaatgtgatgagaccagtcagcctctgccacagtctcccagcctgccctggctgtatggcccactctgccttccccagccccatgcttctccctcaccagcaccaaagcccactcagaaacctccgaaggatcattccaccagagagtggattgaggttaacatggcctctctgggttccgcctgatttcccattataggacttgagggatgaggaagaaagtaagaggatatttgatggcggagtcagtcccagcgtccatggatacctgatgtgcacaggactcctggctctccctacagccagagctgtgctgctgggggagagtgagctttttttttttttttttttgagatggagtcttgctccattgcccagtctagagtgtagcagcatgatctcggctcactgcaacctctgcctcccaggttcaagcaattctcctgtctcagcctcccaagtagcttggattacaggcacacgctgccacgcccagctaatttttgtattttcagtagagacggggtttcaccgtgttggtcaggctggtctccaacccctgacctcaggtgatccacctgcctcagcctcccaaagtgctgggattacaggtatgagccaccacccctggtccgagagtgagctcttgactgaggagcagaaggcctctctgatgcgacctcctgagtcagacctgttgatttggtgcagctgtcagacacggcatttctccagctgtgcgcagggagggaggccagagctcctggccgaggcagcactgcattttcagagtggaaacttggacaaaggaactgagtccaaccagggagtcagctccctgaggctccaggtgaaatgatggccctctaaggctacctggagttggaggaaactcttcctttttcccttcttctcttccaccccctcctcttccaaaaagggagttaatgtgggggaaagctgggtgtggtatattagtccgttttcatgctgctgataaagacatacctgagactgggcaatttacaaaggaaataggtttagtggagaacttacagttccacatggctggggaagcctcacaatcatgctgaaggcaaggaggagctggtcacatcttacacagatggcagcaggcaaagagaaagcatgtgcagggaaactctgccttataaagtcatcagctctcgtgagatttattcattatcatgagaacagcagcacaggaaagacccacccccatgattcattcatctcccactgggtccctcccacaactcgtgggaattatgggagctacaagatgagatttgggtggggacacagagtcaaaccataccactgggcttctgacatctgccctgcatttctttgcagatataaggcatcccggttctccgggaacttagtgttttcaatacacttcacctaccttctcagtcaggtttccaagcagaacacctggctccctgcagtgcagccccctaactctgtccccttgcccccgcatgtgcagatgaccaaggtagcccatcgagtctccgcgctggaagaacagcagttcctgatcattcatcccactgccgatggtaaggactgaaaacatgaattcactgtgtatctagtaagagcctcctccttgatggcaccatgggttttaacaaatgtcttcctctcttttttttttttttttttgcacagaaaaaattcatttccagcacacagcagaactcattacacaactaattaggggaaaggctaattacagcttacaggtacagtacgcatgttactctgttttgaacctggagcaagacattcctttcatggagaaagacctgacgggtgttcagggccttctactgcagcagacacgcctgtgctgtggtggtcggtgatgagcaaggtcccagcaggttggaaaatcagcacatgctcaacgttttcttataattaatgatagctccgctctgtacttcagcccggtttaaatccctttaggacaaccatctccccgtactcccaccccagccctgctcccctcctccgggcagtgagaagaaccaagccagcacccaccctgcccagcagtgtggctggggctatcccgctgcggagagtgggactgttgttctgggttggtgagagtggtgctggtgggccctgagccttgccccactgcttccctctgaccaacaccacatgttactacgcactagcaggatgtcctggggccatctgtagctaggcagtagtgaaagaggggtacccttcccagaactgaactcactttcccacaaccaacccgtggcccgtccacaacagcatcaagtgctgacccagcagcctcaaacctgggctcttcccagtaatgcacagggatgtctctggaaacttctgccatttccttcctgccttctgctcctttggtggaacaggtatgacccaatggtctcttcaggtccaacatgaatgaatgggagagctccttggggacagatgacaggcaggcaccctgcctccctcagagagctcttgccctgggctgatcactgccttggcctccagcatccctgcctgtgggagggagggaccacctgtgggcttgatcaggcagggagagctccagccagaagggagttggaccccagtgtggatgaagaggggcagaaggacggggttacaccacacttgagttcccttgtgaaagacgttcagatttcagactttttcaaagtaagtgtggcagttgcatggcagtgttaagcacactgaccatggacgctccaaaggtccatgtgtatgtgttcatgtgggcaactccccaagatatggggcgagctgaaccccccaggtacagagcagcctgcatcgctgcaggctccatgggtatcagggagcaggacccacccagggacacacatgtgggcacagcaaaggccttcacagacaccccatgcatctggagccaggcccagccccaggtaagagcacgggagacgggggcctgaggcaggaggagaaagcttcctgcccatatcctcttgtactacttgatgttttaatgacatatcatagcctaatgacagcattaataaatacttcaaaataaagatgaatttcaccctccaaaaacatacaaagaaggcaggaagaggcagtctagtgtcatagaaagatgtaggttttgggccagatgcagtggctcacacctgtagtccctgcactttgggaggctgaggtgcggggattgccttgagctcaggagtttgagaccagcctaggcaacagagcaagaccccatctctacaaaaagtttttagaaaatagccggacgtagtcatgtgtacctgtggtcccagctacacaggaggctgaagtgggagaatcacttgagcccaggaggttgaggctgcagtgagctatggtaacaccatggcattccagcctgggcgacagagtgagaccctgtctgaaaaagaaaagaaaaaaataagatgcaggctttgaatccctgcacgtgcacagatggttcacggtgctcctaggagatggtggcatcaccgcattggcagtagaataattagccatcatcctattggcatctgggaccgaatgagcccacattccaggcctcattctaagcacggcacggctataagattgtttaattctcacaaagtgtcatgagctggagtctgtgattatcctccccacccgacacacctggaatccgaggctcaggcaagttaacctccacagtcacacagggagtagccaggacgcaaaatctgtggggtgggcccgtgggcacccaggacagcacgcagcccttccacgggagtttcccacactcagagtgtaactgagagagcataggagtgtaatggcgcgatctcggctcacagcaacctccgcctcctgggttcaagtgattctcctacctcagcctcccgagtagctgggattacaggcacgccccaccatgcccagctaatttttgtatttttagtagagacacggttttaccgtgttggccaggctggtctcgaactcctgacctcaagtgatcctcccgcctcggcctgccaaagcactgggattacaggcatgaaattctatttcttttcagagcctgacaccctgaaaacttgggctgcggctctgtagtccctaagcttgtatccatgttgcaaattcaagcaagcagatccggactgtagagtgttgaatgaagagcttcccaatgttttcacccagttcccactgagcatttgctgtgcctggagagggccaggcaccgggggcgtggtggtgtttgaaggctggttggcttcacgaatgggtggtgcatgtccacgctaggggaggcgcccctctgactgggacagccaggcagatctcccaggaggaagaggcacttccatcaggagtggcatggttagcaaacccacttcatcaactacaatccagccccggacggggcccaggtttcactaaactccacaccttctgtgcgttcccgtcccctggggagcgtatacctgggagagtaatttctccgtgccttccttgcagatttacccggacgaaagccattactttaccagctccagcctcaaacagcatctgtaccggtccatcatcaacttcttcgtggaatgcttcaggatccaggacaaactgctgacagtcacagcgaaagaggacgaggaggaggactaagctcaggtcgctctaagcacaaacgtggctctttctacaaccagatgcaaccgagggatttccctgccctccctcttccctcggaggggcggggcggggcggggccgggtgttccatagcatgtgtgtctcggatgcggaaggcagttttgcttgggaaacaagctccttccccggggtcatcactcacggcctccatggcaccagggacaacgctgtccccgcagcagcgcctcctcccggcgcccgagagaccggcacgccacggcccctcccccaaggaacagagcaaaggatggtggccgcaggccccacgcgagcccacaggacaccggcccctagattccagccaccaagcggaagcatgagacccgcccacactagcctctgtgttcccgttagggacatcacaccctgtctcacgtcgcagtgccatggacgcagcagttacagcaccattgttttagcagtgcgtgttcatatatgggcttgctacttcctgtaatgaggacgttcaacatggtgaggggctacaagaaaacgcttttctgtacagagtcttactgtagctacgctaatggttaacctgatagaattaactcgtatttttctatggttttaacctgatgctccactgtctccgtcatggggttgttttgctgtttggggttgggccttgtttccctttcctttctccagtccacgtgtagactttgcgcttgatgaagaagcagatcggaagtaactgctccctcctcaaggttgtcttcagacgtcttggggacgttcctaaacactgagggggaagacagccaatagcacccattaaaagaaatacctaaataaaacctctctcccactcagctatgctagggcttggctgtaggtgtgcactgtctatttacatccgtccttacaaccatccttgtcctccttggtaccgtatcaagctctttcccatgacatttggtttaaaaaaaaaaaaaaaaaaaaaaaaaaaacagaaaaaagacaaagcgtcaactccacccacaggcccgctgtgtgtgctcgggccacgggagtcctgagggttctgtgggcctgcgcgcatccctctcccatcgtgggggtggctccgtgaccttcctgccacgagcaggaggttgatgatgtgctacgttagccttgtaagatacacccccaccaaatgtgcagccggtgttcccagtgtatatttcattctcttgtatataaaggaagcaatgtgtgtcaggcctctgtgcagtcaacccagcctcctcccgccagtgctaaccccgtgttgagcctgcatgctgacactgtggccgatctggactctagaagtgctagtttgaaatatatccattactgtcatttccttttgagcttgtggacaagctgaatgtcaggactgacttcgccagctcccagccctgcgggggtgtccttggcatcccatcagcagaggagatgcgtccctgttgcattttggcgtttggggctttgggtttatccacatgagctctgaacgtccgttatagttagggtgattggaaggtctccatcactgggtgttttaaaggtgattcaccaccatttgtgaaaggaccaacgtgctgataaacaggaccgatccgagtgctacatgactgtgcgtttgctatttcaatgggcctgaacgactacaaagccagctaggtctggaaggggaagccagctctggccacgacatctggtcggagggaagtggggatgtggcatggtagcgtctgttcatccatggaataaaacattattttaccactcggattgttcctttcttgctcatcctcccccatcgcaccttagaaagtgtgctaggcttcaggagactttcagagaacccactgggcccctccaagacggatgcatggccacaagagcctgttgtgtgccaaatgaaggttgcatccatggtcgcagcagtctgggtagtagagaaggacgcaaccagtcgaatatatcaaagccccaaatcagtccaagaaaacaaatttgaattttgtcttgggagtcttagggtggagacgcagagctattccctaaccctgagagtgaaattgattctcagtggaagccatagcattgcccactagaaaactttaatttttttttctttttttttgtagagatggggttttgccatgttgcccaggctggtcttgaacccctggcctcaagtgatcctcctgcctcggcctcccaaagtgctgggattataggcgtgagccaccatgcctggcctagaaaactgtagaaaaatgtctccatctgttggaaatgtatccactcatttgctgttatcaatgtcgatgtaaacatggcccagcctgaaagccaagggattgatttaattaattaattaatacttcccgaccatggagcagctgctgcctcagagatgggggatcagtcccatcagccccgctgaattagctgattcttgtcaccctctggatcaagaatcatggaaagaatggggtgggtggagaggaggagttaaaaaggaaaaagaaagaatcaaatgtgaaaggagatttttaaaaaccagacacagcagaggccatctaagtctaacatactcattccccccaaacagtatctctgtgagccaccctggccctctccctggtctcgccccagaaggaggccagtgcccccatcccagctttccatccctgagtccttcccccggaccagggcttgatttgtggataggagttgacggtttgctcaagaaggtgcattttcccactttggaaaacactgagtgtggaatgacgagctaggcctggccctgagaacaagtgttggccgcaaccagcagggaccactccggttcccacttggagaagctttggtctttccccagctctagaatggctttgggaagacgccggcgtggcctcaccaggccgccgcggctgtggttgctgtgcctgcctggctcaaatcccccactgcagccttctctgtgttttcaaactgcacgtgcgtggcacagtagagtgctacttttatttccgttttaaattaggtttttgtttttttttttttttgagatggtatgtcgctctgtcaccaggctggagtgcagtggcgcaatctcagctcactgcaacttctgactccctggttcaagtgactctcctgcctcagcctcccgagtagctgggattacaggcaagcgccaccacacccagctaattttttgcatttttagtagagacggagtttcaccatgttagctaggatggtcttgatctcctgacctcgtgatccgcccacctcagcctcccaaagtgctgggattacaggcgtgagccaccgcacctggcctaaattagttttaatactgaacttccaaccaggcagctatggaattcccaaagcaccatcaggtttctcagcacccagctccaggcccacagcccaactcctgggctgcctggggcatctctgaggccatgggccatcaggttcacaaagacatgcacgtggggggacctccatccccactggcctgaaaacatgctcctttccctcctgcctgacccaacccacccagaagcagtgatttaagggattgattgttttcgggaagcccctattaaaatcccctctgtcacagaagagcccggaaggacattttcagaagctcccttggtgctccctcctggtacacagctgcgtgttcgtagacgggcagctacgccgagacgggcgcctggtgagagcctggatgtgcccacggacaagggccaggccataaatcagggcagggctccaacctgcacctgcagacactgccccggggccaggcatggcctctgcagcagttggtcccagaggtcaggatttgagcagtaaataccagcttcccttattctcagccctgcttctaactgaggaccaactgggaaaagccagatacccacaaccaatctcctgggacgccctgcttctgagcgcctccagcttcccactccagcagcctccagccagagcatccctggagcctccttttctccaccgtgaagctcacccacccccccgtccgaacgcaggtaagagcagtgagccccttgctggagaaagctctggataagcagcctctgctcacactcattttagtacagtcttagccttagcggccatagtgaagtcccatagactgggggcttaaatagtaggacttgatttctcacagttctagagcccagaagtctaagatcatggggccagcacactcggttcctggtgagggttctctccctggtttactattgatcgtcttctccctctgtctgcacgtggcagagtgagaaggagcgagagggagcaagagcatgagaagagacttctctgatgtttcttcttacaaggcacaaatcccatcatgggggacacacacttatgacctcttctaaccctaatcacttcccagatgctccatctctagccatcacaccggggcttagggcttcaacagtgaatttggggaaacataacattcagtctgtcacaggtggtctttgtttattttcacactggcattccagggagaaaataggtgttcttttatttcagagaagagttgctgaggggcctctggggactctgaggccagggaaggagggaggcagaggaggcggacagagcctcaggagactgacctccctgctggggctccccaggggtccagacaggcagacgggcagccttccagggctgctcccgaaggcctggcttcccctctgcaaaccacaagctccaaaatggtcattctccatctgaactcagccagtgacactatacagatagggaatctgaagcccagagaaggcaaggaagttgtccaaaaccacgcaggaaacagtcacagtcctgcattccttccgcccttttttcctgctgtgttttcttcaatgataaactcacaagtcctggcctcagggccccgggagtagtagccagctgcctttctccacagagctgggctgggggtgtctagcatggtcccttggggtgctcgtcctcacccgtgtgggtgccccaagcacagtctccagccaacatggagcctggctcagtggacatgggcgtcaagatccaggctctgagaaaaccacagagctatgggtccttccaattcctatccagccagggatcctttctagaaattctcttttttttttccaactttttttattttatttttaattattatactttaagttctagggtacatgtgcacaacgtgcaggtttgttacataggtatacatgtgccatgttggtgtgctgcacccattaacttgtcatttacgttaggtatatctcctaatgctctcctttccccagccccccaccccacgacaggccccggtgtgtgatgttccccaccctttgcccacgtgttctcattgttcagttcccacctatgagtgagaacatgcggtgtttggttttctgtccttgcaatattttgctcagaatgatggtttccagctgcatccatgtccctacaaaggacatgaactagaaatcctcactgatcggcttaccggcccccgatgcacagccataaggtagctctgtgttgattcccagagtgggatcggaagtggccacaagttcaaggagacacgtaaacacacagaagagccgggtcagccacccgactctgtaacctccccccgggagaaagtgcgtgccacacgctcagcatgggcctggcccaccgtgggtgtgccagcaatgaacacactgccgccttgcccaccccaagtaaagggaaccccagaaagccgcaatctttgtctgttttgttcactgcagaagcctcaacacatagaaccatgttcacgatcagagggaaggggagggtcccacctgggtcacatcacggtctggaggtctgcaagaaacaggtggatgctgggggtgaccagagccgccgtgtctgcggttccctcggtgggaatgtgctctgtgcgtccgccgggctggctcagaagctcacggaagccctttcaacactgtgcagagccaggtggacaataaaatgtttgggaaagaggagaaccgttttcaaaatgatatgaatatatttaaatccattaaaatgtttcatttgacttacattcgtttatcttcaacctcttcatgagctcagtgagtcgagttctgttagcttccatgtgtaaaccacaagcataggtacggtagtataaaaacctaaacgtcaggaatggaacagggcccgaaagaccgtcatgaagccatctgaatgggagtcctttccgagttctccatgtattcctagtcatttacagttgcccacaacttatttcaactccttttttttagcagattgcccctactgaatttttccaaatcactcaacttcgtttttctaggaatgacaccattttgtttttacactcactgtccagagtttaagtgggattgaatccaatttggctccgtggataccactgtgctccacccagcacccctctcagagcagggtgggactctgcaggacaggacactgtggcccagctcctgagcatgtgggctgagctgttcacagctgggcccttggctagcctaccggacctgcaggggacctgcctggttgaaggtcacagaccctcccaggagcgccacctggccaaggaccgtgtgacttgggataccaatacccagtccctctgtctcaatttaggacaatctcaaaggttatcccagccacagaggcttcagctcaagggcgacgtcctgggggacaggctgaggccgacaggctcagcctcagccccccggtgcgtctccctagggcactaccagtgaacctgcatgaggcagcggtccctcagagagtctgtttctagggatcctaatcgaacctatgactggagtgagaagtacaactacaaaggaaatgaaacaaaacaggtgtgggcgcaaacccaacagacgctcggcgagcccagcggcactcacctctgggggatgcaggcttccacctggaggcgaagaccagaccggccgaccaccctgagtgtgggcagtccatgtgctacacagagggatggagccgcagcagacagcctgcaccctgctttcataatgtcagtcagggaactgctaccacccagactagacacggcccacctggaacccctctgttgacctgcaggggattcgcttgggggcagctcagctcctcccatgcctctgccatggaccccaggtactgcctgctggcctggtgggacctttgctccaaagccgagtgactaatgcagaagcgtggaggacccactgccagcatcctctgaacaaagaagctgctccctccctcccagccttggccctagcatgggaagttcctaagttggaggagtctggagctccctggctttgactttggttatcataactaatggctttccagacagaggccagccccacccatgagctggttattcgtctaatgtggtttgtgtcagcctggtgggaacgtgtgctggcagcttcagcagcctccacagtcagttctagggttcacaggacctgcttggtgaggaagatggtggcacgaggcagaaacagcaacgtctttgtggttgtgaggcctgagaccacatgttcctatcagctgtgtaacatcgggcaggtcccttcatttctctgagccccaactttctcatccttaaaatagaacaagtacctgcctctttagggtgttgtacaaattaaacattgtctgataaagtcctttgttaacctgtgtgctacatgagtgtggggtatgaccactgtaagtttcattactgttagggttaggaaggaactacatcagtcccttgtaggaattacttttgtagccgtggacgtgggttaacagagccacgcgcttgtcttcagaacatgtacgggtctcaaccctgaggctgtgcccttgtaggaaggctggccttcatcacagggccccccagcccgggaggacccaggaagctatttttgagagacttgggtctgcaggtctgactccaggacaagtcgaggttaacaaagttagaatgagaagcagcttcccagagggcagctgaggcctcgcaggaggcctgtgtcagaacgtccactttaattaaaatatttgcctgcctgtagcctgatttcttttacacatggtctaatttcttatagtggacctaagtgactctcacacaccaccctgcaaggcaaggcaagagtttttaatttgaagtttcgaccattagggaaattcatggatgggcttcagggggtctatgagtccctgaaattgcaagccaaagttgtgtgtccctgcacgtctaataccatcctggtggcaccaagaattgccacctggaaacacaagccattcatgccgaagggctttgggcctcatggactaaactcccttacaaatctcactcaatgagacagcttctggcctggaagagtcatcgaggcacctccagacgatgtgagaatctcactgagttttctttctctttctctagaaaagggctattaacaaatttgagacgttgatagaagactttcatactcagccaagtagcagccatgaacctcagcccaaggagaatgcgttgactgcattttcacctttgttactactggagtctcagaacatccttgggaaggacatgaggcaagtaacataactattccaatttcactgataaggaaggtgcacaaaatttaaatgatttgcccagaggatgtagctggtttttacttcaaccagctctaaaaccctaattcccagccaaaggcttttccattggaaggaaaagggaaaatttttcatttcccaaattagttatcccagtagatcaagagacccttcaggagacctaaagtcaacttgtgaagattcacagtgttaatttctgcttgtctgaacttccacagtgatgaatggagccacagccagtcgtgctaagctgattaaatacgcactttgctagccacccaccatgatgccaactctacccgctttttttagtattcctgtcgtgtggagtccactcccacatggaatcaggcttgacccctgtgactacagaatactgcagaggtgacagtgcgtgaatgccaaggcttggtcattaacggtactgcagcttctgtctttctctcctggccagatggctccttctgtgggaagttggccaccatgttgcaaggatgttcaagcagctccacggagaggtccatgttgagaggaactgaggcctcccaccagcagccagtgcaattctccagccatgtaggggcgccaccatggcagtaaatcctccatcctctgtcagtcccacccatgactatggccacagctgacatctgattgcaacctcaagagagactctcagacagaattcttggccaaggcactctcagattccaaatctaaaggaactgtgagcaatcgtaaatgactgttgttttaagccattaagttttggagtgatttgtcacacagcattcgataactaatacaactcacaaccacccccaaaaactctgccagcacccgcatcagtgcctctgcaggacacccctttctgtaaatatgggataggctggggcataagtgacccttgagagtgggcgcagactctgaaccgtctgacataagtcactggttcctagtcccaagcatcaaatccctgctacattgggaagggttcacaaatggcaggaagagaaatggtagaaaaattccttcaggcactaactggagtccaccctagcactaccacccctctttcttagaagtggaacccccagtttttaactgggcctatggtcatccagaataaaaactgttccggcctcttcgctgagcctaacttctggccactgggatgtatgtgacatgccacatggcagctgccaagacacttcctcaaaagacagcagggaagcatccttggtctcatcttctccctcctccctctgggttcctgaagacccaacagagccttggtccacaaggtggaagctccgagccaagggtgacagagagcaagcagatgctgcctgggctcctggcaggtgggcacactataccagccctggtgtccctcatcagaacgctctatcttctttatcttggccttttctgtgttttgcagtcaaatttgatgccagctagcacactgcactgtgagggctgaattacacaggccagcggcttgatcctagggcccagagcctctcactgcaaaacgctgtgtagttgccagttattcaggacaactaagcatttgcattggacacaaggcagatgactatgcatccattcactccaaagatcacaatagccacattaataataataattaacatttatgaaaagcctgctctatatcaagcactgtgctagcattctgcgtggataaacacatttaatctctgcacaattaacacatttcaatctacaactaccccatgaggttgggttaccattatttacgtttggcggacaggaaacaaaaggaacagagagacgccgtcactggccccagataacaaagccagtcagtgctcgggagggagtcctgccaccaccagctccctctccaaagggaggcccttaccaggtcccaaacccgagtctacccacgtttgggcacagcagatgaactgtgtgacctccatgtgtttgagtaataggcttggccttggcaggttgatttgtttgagctgaaagagaacaaagaaaggccttctgcccaggtgcctggagaggtgagcaggggtcgctggtctgcgagaggctctccagcaggagctgaagaactcgttttctgggagacaaagggagggctggcttggcctgggaggctgggggcactctctgtggcccagagggagcgccatgcagtcggtccagagaagctctgagatctggggccacctgggcagcccagggtctgcagcagcctcctgccagtcaccacggctggaacctgggggctgtggagggctccgaggtggaggatggtcccatgtgtctgggtgagcagcagacaccacgggagcagctgtttgacctgagccagtcacacaaaggagtcaatttccagctgtgtgggagcctgagtccaggcacacttggcaaggagcccttggtggccagcgtcctagcctgagatggcagggggcaaagctggtgaaacgtaggtcgtcagtggtggtgagacccactctcacccagaggccggcaaggtcagtgagcaagattatccactgtagttcgttcaatcggatttcactgccagtattccctgtggagaagagtggtataatcaacataatttttttttttttttgagacggagtctcgctctgttgcccaggctggagtgcagtggtgcaatcttggctcactgtgacctccacctcctgggttcaagtgatcctcctgcctcagcctcccgagtagctggaactacagatgtgcgccaccacacctggctaatttttatatttttatagagacgggctttcaccatgttggccaggctggtctcgaactcctgacctcaagtgatcctcccgcctcggcctcccaaagtgctgggattacaggcgtgagccaccaagcccagctcataagtatataaatatgatgaattcattgaccagtagagaagcaggacccatgaatgtctccaaattctgttttcaactgcaccaagactgctggagttttacgtctcagatatattagcagatgtgtgcttttccaaataaccatttttacggaaatcttaatattgtctgaaagtcagcatgattgtcctgtgaatgagatttttactcgcttggcggaaggaggcagaatgaatccactgcttgagatcctcttctatgactgcagcaactgtgggctttgaggaccttgagctggacttagatgaccctctcagtggtatgctggcatcagccttcctaatagaaaacaaaaggagagaaaaacaaaagaaaagaaaatcccaacccatagagtctgtcgatctccgtggtgtaagtgtttccactatggccaacgtcaaacacccaagctgccatcactgaaaatggagttgggaagcaaagggccaaaccccttcccgcccatttccagtgagtaggtgtgacactctccatcaggcaccactaactctggctaacaccggttagtctatggggcagggcctctaggagggccaaagaatgcagcaccaggagttgacaaacccacaccctccatcctggacaggtttcttctgtggcattgggcaggcacttccacaaatcgaaactgactttttcccacccaaatgacaagttcccggggtaagcgagacggtttatttcccccatacctcacccctccgtcccccatcaacagcgcctggctcacgtggcagttctgagcaactggagagacgtggacagaatgaattgcaagaggatgtggggggtcctagctccatgttgggcgggaccaccccgcatttccatgctcctggaatcccaccctgaagctgagctccacacccctgcttctagagcactttcagagaccgcagcctcaaggaggtctactgattcagtaaccggcagaggctgtctggggagcacggtggaagttaaacgccatgaagagagcatccaaggcccccagactctggggtcaggagtctcacaccaccacgctgctggctcaggcataatttatcaggcttcatacatatcagaggaggccgcagctgctagcactccacgccagccctgcaaacatttcttcaattattcagtcaccaggcacagggagctagtccactgcttcaaagttacattgttataaagtaacaattacagcaaggtttagggctgagctcccaggcctggacactccgccccacaaccctgaccaccccagtctttctctctctctctctccagtcgtctctctctttctctcctctctctctgtccattctctctgtctctgtccccatctttcttctccccttctccctctctttctctctcctcttttgtcttttccccatctctccctccctccggccttgtatccttccttgtctctccccgttgcctcccctcctcttccctccccatctgggtgggtggtcaggccttggttaggcttggccatccagagaggaggggaagcctggtcgagcacccagcactgagcagagcagacagacttggcgaaggaggtgggagcagggatcaggagggagggtgcagggatgcccctgctgtaacaaagcatcccaaacccgagacttcaataacggggttttatcctatgctgctggagactgagctccgagatcaaggtgtgggcagggccaggctccctctgagagtgctagggaagggcctgtcctccgacactgtgctctcccccaggggatggggcggggggctccctggattgtggctgggtctctccacactctccgtggcactctccctctgtgcgagtctgtctctgtgtcccaattcccccttttcataaggacagcagtcatatggagttagcgcccaccctgctgaccgcatttcaacttgatcacctctggtcagaccctgtcttcaaggaaggttccatttggcggtgccatgggttagggctcagcagatgttttgaggaataccaccattccagcacaacagcagggcctcctgggtgggaggaggaaggagcagctggggcgggagggcctgtgtctctgaggcagcttgcggctatggggtaggtggccccgtgagtggacttgggacagggccttgctgtgtctttggtcctcctaggaaaggcctcctggactctccggggctctgcccttcccgattgtcagcagtgctacggcctggtctgcagggtcagcctctcatgcctgccatacctgggcttttttttttttttttttttgagatggagtctctctctgtcacccaggctggagtgcagtggtgtgatctcggcttactgcaacctccacctccctggttcaagcaattcccctgcctcagcctcccgaggagctgggattacacgcaaacgccaccaagcccggctaatatttttgttttttgtgctagagatggggtttcaccatgttggtcatgagaggtaacaacgtgctagcagcccttgctagctctcggcacctcctcggcctcctcggcctcggcgtccactctggcgcacttgaggagcccgtcagcccccggctgcactgaaggagcccctctctgggctggccgggccggagccggctccctctgcttgcggggaggtgtggagggagagcgcgggcgggaacctgggctgcaagcagcactcatgggccagcgcgagttctgggtgggccctccactcagagcaaccagctggtgccgctggctgggcagtgaggggcttagcacccgggccagcagcagcagcagagggtgcgccggatcccccagcactaccggcccgcccgcactgcgctcaaattcttgctgggccttagctgcctcccctcggggcagggctggggacctgcagcccgtcatgcccgagcctccccgcctccacccctgtgggtggagcctcccctaccggcaccaccccctgctctgcgggcccggtcccatcgactgcccaagggctgagaggtgtgggcgccctgcgtgggactggcgggcagctccacccgcggccccagcacgggatccactaggcgaagccagctgggcttctgagttcagtggggacttggagaacttttatgtctagctggaggattgtaaatgcagcaatcagcactctgtctagttcaaggattgtaaatgcaccaatcagcactctgtgtctagctcaaggtctgtaaatgcaccaatcagcaccctgtaaaaacagaccaatcagctcaatgtaaaatggaccaatcagcaggatgagggtggggtcagattagggaataaaagcaggctgccccagccagcagcggtcatctccttgggtccccatgaggtgggagcacgtggagccccatgagctccccccatggagggaggagcagggctgcggtgtggagcctgcagtggctggagctcctgtcctgcagagtcagggatgagacgtcttcccctccttcctggcctcaggcacactggtgtctctccagtcccaccacagtcctggctccaggtcttgccaactcctccccagcagcctcaaggggctgcttctgatgtaacggcttctgcagggcgtcgcatcctcccagctcctgctgagccctccctgctcccacctcctgggctgcactcctcagcctgctctctcaggcctccaggacctggggaagacatccacagtttacagggcacttcctcagaaacctaattaacagtgtcacatgggtgctttagttttgttttacactggggtgtaaacaacaagctgggtgcggtgcctcacacctgtaatcccagcactttgggagaccgaggcaggcggattgcctgaggtcaggagtttgagatcagtctggctgtgtctggaattggtgggttcttggtcttgctggcttcaagaaaagccgtggagcctcgcggtgagtgttacagttcttaaagatggtgtgtccagagtttgttccttctgatgttgtgtccggagttttttccttctggtgggttcgtggtcttgctgacttcaggagtgaagctgcagaccttcgcagtgagtgttacagctcttaaaggcggtgcatccggagttgttagttccttccggtgggttcatggtctcgctggtttcaggagtgaagctgcagaccttcgtggtgttacagctcataaaggcagcgtggacccaaagggtgagcagcagcaagatttattgtaaagagtgatagaagaaagcttccacagctgcaccagtgcctcccctgcagctcaggtcctactcccggaaccagcttcatggctgcccatcagaccccaaagcaggttcccctgagtgtagccgatcttttctcatgatcattgttaagtagaggcaccgtgttgaacagcagttctctcgattcccggcaccagcttcatgactgcccatcagaccctgaagcaggtgctcctgagtgcagccgatcttttctcatgattattgttaagtagaggcaccgtgttgaacagcagatctctggaacctactcatcgtgcataacgtgtattctacccccgcttcccctcctccagtcctggagaccccaaccctcctctctgcttctatgagcgtgactgtttcagattccttgtagatgggagaccatgcagtgtctgcctttctccttacttcacataacataatgtcctctgggttcatccctgctgtcactaatgatagggtttcctctttttcatggctgaatagtactccatggtgtggtgatggcctggactctattcattcatttgttgatggacatggaggttgcttccactacttggctattgtgaatagtgctgcaatgaacttggggtgcagacacctcttcaaaatactgacttcaattttttgggtcaatacccagaactgggatggctgggtggcaggtagttctatttttagatgtttgaggaaactccacagcattccccatggtggctgccctggcccacattcccaccgacagtgcccacaaggcacacctgatcccactcttccgcacgctttccccatctggaccctcttcacacccctgatctctggcagaggaggggactgggttgggggtccgccttcccccactcactctctttgtgacttcagcaaccacctcggcctcccaccctgttcttccccttagcaacacgaaggcttgggcgagagagtggcgaacgccatttcccactctaccggttcgggttcctatgcttttccccggccctgagagacagcactgccaccctttccactcctgcagggagatctgccacacgaagtaggacggatgtgaagcaaacaggcgacagggtcacctgccctcccagacagccttccacagcagggaggacggaggagagagggaggggcacaccctggaggctggggaaggtctcattcctggttggcaaactctcctcttcatgcccaccctgcatgactcctcccaggccgctaccagttcacaccccagcatctgtgcccggcccagccctgggcactgagcacagtatggcagcacccagcacacagaagccgggcccctgcacagctggattccagtggggacagaacgacaatacatatgagaaatctattgcccgagagggcgcctcgcacagagggagagcagagcatgaggaggggctgggctggggtggaggcatcgttctcatggaggtggcatgggagccctgcttagaaactggagtctacacaaagccctggggagtgggggaatgcgtggtgcagatgcctgcgaagggggctccaggcagaggaaccccaagttcatggcccaaagggagtgcctccccagcacaaccccagaatgccagagagccctgtgtggccagagtggggcggaggcacagggagaggctctatctgtccatccatcctgctgggcgggtgcccctcagaggccacagggccacaacgtctcctggctctgtgcacacccaccactgttgcctgttgtctcaaggggccagcacagaaccacccctgtccctgtggacttgcccagatggacgagtgcttggcacccacaacaggcagacagcaggacccaggtctagcagtgtggtcagagaatgtctctgccccttctcaacacaggccagactccatctccagcctgtgcaccatccctgcagcccaggaggagctcatgctggcatcagcatccccacacccacattccttttggcccaggccccactgcagagctcggactgctagaccctggattagccacccagtcaggaactgtccctgtgaactttataaaattcatcagggctgaggggaggaagagaaaggaaaatagaccaagctgcagcacactcagcatgaatcactgggtcagcctgctctgcaaccccttcctcattgccgtttgctgcctctcaccccagaatcacataaagcctggcacagattacagatgccttgaactgctctatagacaagttgaacattatgaaatgttaagttttgtttacatttctctgagatatcctttcaattcctgtgtaccagtgcaactactgatgccagctggtctgaaggactccataaaaagctgagtccccaccagagaatgcagtttccacctcctgatgacttcaccctcctcaccctgaccaatcaaccatcccagttttccagtacctcaccctccttaacaaccccagcccagaactccccagggagatggatttgagggtctcctcccatctcctcacctggagccctgccgccactaaactctttctctgctgcaaaccctgctgtcttggtgcattggcttgcgactgcacggggggctatgacctggtggccttgtaacagtcagtcctgaacttcagccctatcctgtagtttggcccaagatccctgtggtgtccagcctccaagctggtgccctgagatccccctcctggtgctcacccttgtggaggccccttccacaatgcacaagggctggttggtgtgaccagcagtgaccgcatgtcaatgctgagctaagaggaggtaataagagactgtggcttctaaggctggtgcttggtctttccccgctctcctctctttctctccatctctcctttccttttctttctcccagtctctgtctctcctctctctgtgtgtctatgtctgcctgaatgtctctctctgtctcatcactaactctggggaaacccagctgccactcaagcagaggcccctgagcagcctgtcttgcagagccctgagatggctgcagtccctgctgagagcctgactgcaaactcccaagagagcctgggccagagccacgcaatcaagcctcagccagattcctggccctcagacactgggagataatcagtgtggtgttaagcttctaagtattggggttgtatgttacacagcagtaggtaactaatacaatcccagatgctagtcacctgcctcccctaacacacaggagaccgcctgtctggacagcctcattggccccatggattcccttggcctggcccagaaagctgccctcaggagctgtagaactgagatccttctgcagggccctgtgggcctgagcacatccttgaggctccagttctccctcaaaccccagcccaggggtcacataggcaaccaaaggtctttactttaaattttagaaaattgctaactgcagctcaatgaccagcaggacagcggcttgatatcagataatggaatctgagcagcagctgatgttaatctgattgttcccgacagcctgggcagggccagagagacaggcttcaggtccccgcaccttttgtctgcaacacagggtcaagttttgttcttgtcatcgggccatgtcttccagtgtcatcagctcagcacttcatgttcagcatgtaatgacatttgtttttcttgctaattgctcttggagtggtttccatttccccaactagactgaaatcttgttaccccagaaacagtgtctttctgtgagtctcacacagaaaggagtggacggtgggctgcctctctgttctaccctgtattgtccctaaccagctgtccaccagagcacgatgaccacagataaatgacctgccatgtgacatcaagttgctagattcaccagcaaccagtcactcacccgtttcctgagtatagatctctggctaacgactccaccttgcacactacaagaatgtggagcaggctgggcacggtgctcacacctgtaatcccagcactttgggaggctgaggcagatggatcaactgaggtcaagagtttgagaccagcctggccaacatgatgacaccccatctctactaaaaatataaaaaattagctgggcgtggttgcaggtgcctgtaatcccagttactcgggaggcagaagtgggagaattgcttgaacctgggaggcggaggttgcagtgagccgagatcgtgccattgcactctagcctgggcgacagagcaaaactccatctcaaaaaaaaaaaaaaaaaaaaagaacgtggagcaatgaccataaagagtgaagctgacactgagaagtgctggcatccccctccgtaggccaggtgcggttcatcagcaccctcgggtctgagcttttgagctgaggcctttccaagcctcaagggagcagatggtagaagaaaaaaaatgttaaatccccaagctggaggaaagtgggtttgccaagaaaaatccttccaaaattgtgtctccaatacgaccgtgttgtctttgacagcagagacgtttttgtacagcttccctcctatttaggaacagctgacgtgaactcgacatcggaaatataaaatcagcagggaagtgggtctgaatcacgggaaagttagttttttcaagtgccaaggacaattgaaagcacatgcttttcaatttgtcgactggtacaaattggtttttggcacaaacagaaatgtgaccaatttctacagctgcgaaaacgacctctgtgcagcaggacggagacaggggcagctggcgtccttgggtgggctctgagccccgttcatccctgagactctcctccccgctcatgtggccccttctctcagccctgcagcggcctctccccacccggcattgctctctgtccgccaactcacgtttcttgaacagtctttggaaaacatttctgggcagtggaaggggtgtatctcttcccaattattcaagaaccagctctgtgaccctggacaggtcgctggaacctcttgggcttcagccaatgggaaatgagatggttggccagagggtccccaagaccccaaacctgtgaaacccagaccaggcgatgtggccacaggttcccaagcagcggaaactcttagatcggcctccgcgtctgagaacagagcgcagcggaactgccgcgtggccagcacctgggcctcccccggagctgctcaggagtgcagagttcaggccttgccccctgctgaacttgaactggactggccctgggaggccactcctcaggccttcaacctgtcatctgagagccgccagcagatggcagcaaaggcccagctctggcaggtctctgaggcctcccggctgggccgggccctggtacctggaggaagattgcacgctctgggactgcgagttgcaaaggtaccatgaggagccccgggaggtgaaaacacttcccgggctaacgtggcgccgagagggactgcggacccactcttggcttcctctttagaggagagatggagcggggtccgaagcgcacaggcttcgaaggaactagtgagccagccgagggcagcgggagccgcagaaatcagctcggagagagtcgcgtgcaggctgcaggtgtagggagagccggggtcaggctccggtgcgccgcgggggatggcggaccctccgggggccgtgctccccgcattcccaccacggcgcaggcatcgggtgccctgctcatcgcccctccagccggggccgggcctgcctctggaagccccacgggttctctggggcctttggttccagcgggacccaggagagcagcagcttttgtccgtgtgggccacggtgaccttcccagacacaaaatcaatgcctaggaattgcggagtgacccatcagcacacgtagaaagggtggcatttgtgacttttgtgcagctcgctcaggtgacacgaagtcagctccgagccctgcccagccccagccgtctcctcccagcagcttccagggctgcagccactgcaagaagccaaaggggaacccgtccccccggggggcctggggaccagcaagacgaggcgggtaaatgggcttcgcgggcggccgcaggcaaagccagggaggatctcacatcctcgtcagctcggcagcagcaacacagcaccgcgggccagtgggctcagcagcgggcgtctgcgtttcccagtcctggcggccacagcccgagatctgggtgtgggcagggctgcttctgcctggggcctctctcctcagctgagctgccgtcttctccccgtgccctcacctgactgtccccgcgtgcacggctgtatcctcatcttctcttcttggaaggacaccagtcctgctggatcagggcccacccacatgacctcattataccttactggccgccgtagagaccccagctccacataaagccacattctgaggtcctgggagttcgaccggcagcttatgaatctggaggacacaattgattcagcccgcaaccatcgcggaggctttgcttggggcacagctggcagagtgtgagtcacccagcgccagcaccacacggtggtggtcgggggtagcacccggggctccaggcgcagggagcccagctgcagtgcgggtgctgctgagagctggagaacgctggggagacacgcggcccgggcttcccgggcctggctggctgcactgccccccacacccgggggtctgacttagcaggtcttaggggtgtccaagaacctacttttaaccagtccctaggtaccttaagaccaggaggaggatttggaagatcccgctttgtgctaatttcatctaatccttgccataggcctattagaggtaagaaaacagagctacagaggttgaagaaaaattctcaagatcacattaaaagtacatttaccattcaaacctagggtcatgtggcttcagagcccttgttctgaaacccgtgccggcattccatttctagaccagggtggtgagcaccaaagccccagagaacccaagggggttccagaagcaggcccagccctgggtggagaggcggtgccaggatgcctgacactgcacaacctcagcccaggacacctgcagcccagcacacctgacacccacacaacctagcccaggacacctgatgtccacaacctagcccagcacacctgacactcctgcaacctcagcccaggacacctgcagctcaggacacctgactcccacacaacctcagcctagcacacctgacaccatatgccctcagcccaggacacctgcagcccagcacacccgacagtaccctacctcagagtagaggtgatgttcagagcactaacagcttcggggcacaacccgctggggctgcccacattgggctggaacagccccctccaagctcccccatgtcaggtatttggctcccctggtgccggatgatgaggtgatattagtgggcggggacacccaagagaggggctcatgcagcgctactacaaactcgtgtgggaggatttccatatttcagtatttttaccacaaatcagggctccacagtgccggctgctgactctgccattcttagatcaaacttctaggctcttagtgcaataaaatacaagtgacagaagtgtccccagagatcccccgcagtgtgcggctggggttacaagtggatcccaagtctcctcatccccaaagtgccatttgaccaggggtacccctcacagcagcctgcagcttcccttttcctctcctccatccttagctttcccaggccaccccttcccagcaccaatccacaaaaccacgtgttgcccaggtccccgtgtcttggctcaataggtgactccaaaacaaaagcgttgcatctttaaaagtgccatcatttcctgtccgtgtgtgctggcaagactggcttggaggctgggatcagggcctgggaacagatgggccgagtggggggcaggcaggggcaggcggggaatgcccagcaagaacaggggacgcctacgtaagaggaaagctgtcctgggcgccccaggagagtcccggctcggggccctgcatgtcgccggcagagagagaaggccggtgggtgggaagtgtcacctgagccccctgctctgtccacaggcccaagtaaaaggagacccagcaccacctgccataactcacagtggctaagggcgcgatgttggagcctgtgcctggggtagaccctggtcatgctactgaaacctctgtgctctgccctcctctgctgtggaagggaggaagtgacagcacctgtcttctgttggcattctgaggataaagtgggtgtgtatatgcacaggacttagctcaggatcgggcatgggcaagcacagtgcaagcacctgtcctaactgtgcactgtttcccatcattactatttaattattattactctcattcctctccttggctaatggggtgtgacggctggaacgggaaccaggtgcatgcatcggacgagaagcgcacttggactggcctctgtgtctgatggtgaattggtgtttctgaggttcaacctctggatagtgcttctgtgcactaaccagtctccacaagcctagtaaccaatcttcagatgactagtaaccagtctccagatgactagtaactgattgtaaccaattgccagatggctagtaaccaatcttcagatgatcagtaaccagatcatgactagtagccaatctccagatgactactaaccagtctccagatgactgataactaaccagtctccagatggctagtaaccagtctccgaatgacttgtaaccagtctccagacggctagtagccagtctccagatgactattaactaatcttcagatgactagtaattaatcagtctccaaactagtaacccactgccagatgacgagtaaccagtctccaaatgactagtaccctggtctccaaatggctagtaaccaatttccagatgactagtaaccagtctccagatggctaataaccagtttcccgatgactagtaaccaatctccagatgactagtaactggtctccagatggctccccaagagaccacaccttcagtgtcatgcgtgggacgctcccccaacactgagctgcctgtccttgtgtcaccagtagcaccatggtggcgacacatgtcacttcagagactcagtgatcagaaggcttgaagtacccaccttggtgtctgggaatgcacagtccagcccacgctgaagagagaagtgggcagagcaacgctggtcagcccccagccctttccgtcagtgcagccccagccgacatggggaagggctagctcacatcttccagcccaggagacagggatggcctggagaggtcatgggaccctgtggggccatctcagtcacctccagccagggaagccacgctccgctggggcgggagagttgtggaacaggctcaggcagcccctgctgtgcccctcccacaggatcctgagcacagtgaaatggtccttgttttagggaattgagttttggagtgtgtgttccctacctagctatatatatcccaaaaatatcctggtgttcaggccaccgtgcccaatggaagagggcaagcccttcatatgtgtatggctggaaaaggactctcatcgatttcccttttgaatttggagccctcaaaatcatctttggagaaaggcatagtcctgtctcccacgcacacatccttaactttggcaaataaacctcctgaaatgattgagacttgtctcgtcacttttctcagttgacaccctcaaggactctaactggggctgttaatggtcaacctaagatcatcaaaaggcttgggatccagttaaaagagcttactcaggtgtaaagtgtgagggcagctgtccgggacacacgaacactgaataatgttcaccagtgctcctggagtcgggaaaggtaaagatcgtttatacagggaaaacacaggtgaattacattttccatggaaaggctgacacaaagatataagatttagttggctactattgcttacactctccaggattgcttaacattccattgtgaagaggtaacaatcacaaggctctctcccaacatcatttaatctaggtgtgaatgaagaatgaggagggcaaaaatcacctggtgagcatcatgcagaccccagggacaaaagttccttatctgaggaatttagaagtaattagacttccctattacctaaaggcacctggttccaggcctctcctcaaaacgtgtgagtaactagaatttctatacatctctggaatgcatgcatgccaaaacttatggtgcaacccttgctgacactgagacaccaaaatgtctacaaatgtaatactttatcgtgcaaatcacccttcagctcctgcttgaaggtccataaatacccctaaggaaaaatccaccgcagtgtgctcagtcctctctagctgaggcacccactgcgctctccagccgcgttctttctttctaacaaaactttcctttggccgggtgcggtggctcatgcctgtaatcccagcattttgggaggctgaggcgggtggatcacgaggtcaggagatcaagaccagcctggccaacatggtgaaaccccgcctctacgcaaaatgcaaaaattagccaggcgtggtggcgcatgcctgtaatcccagctactcaggctgaggcaggagaatcacttgaacccgggaggcagtggatgcagtgagcagagatcacgccactacactccagcctgggtgacagagcaagactccgtctcaaaaagaaaaaaagtttttcctttttcaaacctatgctgttgttggtaaattcttaccaacctacgagttgaccacttcccgatgccaggcattttgcctggcaaagaacaggagcctggctaatgtgtcacatctcaacacaccaaggtcagacagctacagttgtgccccagagaagaaacacagctgttacatgacttggtttccagggcgttaactttaccccttggcaaaatacatttagaagctcctgaaacttattttattttcacatttctccctttccttgaaaattattcagagaaagcatttgttttagtctatttgtattactataaaggaatacttgaggctgggtaattaataaagagaagaggtttatgtggctcacggttctgcagactgtacagtaagcatagtgccaatgtctgcttcctgagggcctcaggaaatttctcctcgtggcagacagggaaggggagctggcacatcatgtggcaagagaggaggcaagagagggaggaggaggtgccaggttcttttgaaaaaccagttctctggggaactcttgagggaacctatagagcaagaactcactcattacctagaggacaccaaaccattcctgaggactccacccccatgactcaaccaccttccagaaggccccacctccagcattagggatcaaatctcaacttgagatttgcaggggacaaacgtccaaaccgtattagtattgcagaggaatcgtgctcaggccctgtattttatcaaatcccacattgccaggagggctcattcctcggaagtcacctccccaggaagggggactggaagggaccaaggtgaaatgtcaaaggaacaaagggagagtagtcctggagcctgggtcaggctgcacagctgcctcttcaatcacagcaattgtctgaacaatcatggttctagttttctcagctgcatgttgactcagttgcagacgaacaccgtagtacttctgtggacgaggacaggacgaaacccaccatgacgctgattcccaggatgagcagtcgcttttgccagcaagttcaccaagagccaaaacaactacttagccaatcccagaaggagggttttcgatcggaaagtctggttatttgggttatatgagttatgaatttgtgagggttatttgattcatctgacatgaatgagatgaaggcacgacattcagttttcatgacaggacacacttctcctcgggccacgctgagtatgtctcaggccacatggctctgtaatacagcctttctcatgacagccacttcatgatttaataacaaaatacccatgcagctgtcacttagggtctttcgtgcacaacttgttagggcctttatgtgccaaatgacaacttcaacacccagctgtggtaggacgacagaagccaaatgaccacaccaatggaacacagaacacacccaacaagattgtaaatgaggaaattttactggttttgacagggtatgaacgacacagccttgtgcccaagcataaccagggcaacatcatccttaccgtcctgggggaaacaatggccatatgttagtgccacatagccaagatgttccatttgggtctataaccaataaatacctgtccttgtgtttaatcggtggcagaccaatcagttcttcgtaagacaagggtgcgggcatacctcattttttatgtctaccccatatctctagcgcagttgggccattatctttggtgtgattttttttgttcctaacacaaagggggatgctgcctaagctggccataagaggagatgagcccaggtgaggtggcttacacctgtaaccccagtactttgggaggccaaggtgggtggatcatctaaggtcaggggtttgagaccagcctggccagcatggtgaatgcccgtctctactaaaaaaaatatataaaaaaaaagagctgggcgtggtggcacgtgcctgtagtcccagctactcaggaggctgaggcaggagaattgcttgaacctgggaggtggaggttgcagtgagccgagatcgcaccactgcacaaaaacctggatgacagagcaaggctccatctgaagaaaaaaaaaaagaggaggtgagctaagtaaacccaccccaaatttgtaatataccgtgctgaaatcgtgctgtcaattaggtatcattgttttccctttcatttggggtggggcctgaggaaaagccaataaactggtttcttctaccaagaagctcttctcatgttcctcattctgtaaagcatcatcaataggtcaatggtgtaccttatccttagtcagactagtgtgaaggacaccagactgattttgtgtcccatccgatagttttgataaatttttgacattctgtccagtcttgcctttggaaaagaaaagcccaccatggtaggccagacccactggaaagggaccacatatccagcaagcgtcattttgtaatctaccagcacagcctgggacccattgcaaaaacaggctgatagtcatgccgtcacataaggactaaggatactagaaggaagttcagtggaagcttataaaagaaaatcttctccatagattaacaacttagtattaaatgtttgtctagcattttgggtttcagctgtctatgtcaaatgccatctttttctctgcctggcatcaactattttgagtcagaggtcaccttctggggaaaaagtccaacctagagtctcagcctttgatatggtttgaatttgtgtccccacctaaatctcatgtccaagtataatccccaatgttggaggagggacctggtgggaggtgattggatcatggtgacggagttcatccttgctgttctgtgatggtgactgagttctcacaagatctggttgtttaaaagtgtgtagcactgccatgcagggtggctcacacctataatcccagcatttggggaggccaaggtgggcagatcacctgaggtaaggagttcgagaccagcctgaccaacatggtgaaaccctgtccctactaaaaatgcaaaaatcagctgggcatggtggcacacacctgtaatcccagctacttgggaagctgaggcaggagagtcacttgaacccgggaggaggaggctgtggtgagctgaggtcatgccactgcactccagcctgggcaacagagcaagactccatctcataaaaagaagtgtgtagcacctccctgtgttctcttcctcctgctggccatgtaagacatgcctgcttcccctttgccttccactgtgattgaaagtttcctgaggcctccccagccatgcttcctgtacagcctgcagaaccaagagccaattaaacctcttttccttacaaattacccagtatcaagttgttcttcatagcaatgcaagaacgaactaatagtcttctttagatgagaagtgttaactgccttctacttcagcagcacaaagtttagcaggcagtactcaataaggtctataccattttggttgaagagagttatttaagaaatgttgtgtccaatagatgaaatctcgtgggtcaagtccatggtctttgaagttttcttctcccaggagctcactgtgaaaagattcttctaccgattcataatttttagttaattgcctcattaagccattgcaatagctaaatatgtctcctttactattaaaggctatagatctgcctgctgtaatttttaatggagataactggtgtttaccaaaagggatcgacctcagattaagcagaaacagtggaagagcttttagccaaggaatttgaaagacctccattaattttgccagttgagctttgattattctgtttgtgtggtccactaacccagatgactgggggtggtcaacacaatggaaatactggagaatgggccaaatttaacgtactggttggatgacttatccagtgatcccagtgtctctgtcattatgaagctccagaggaactccccaggctgcaataatgttttctaagagaattgtactcaccctaaggtcattgctcttctacatagaaacacctgcacccaatgagaaaacatgccaatcattaccaaaatatatgtgtatatttgtgagagcggcaactggacggaatgtaattgccatactttgacagaggcctccctggattattttgggggcaaaggtaacaactgtacatcctgtgtgctacagtcagagaaggtttccaaaatatcgtttccctcaagcaatcactctgtcaggctctggggagttatgtcatgtgcataagttagaaatgataacaaaaattcagcatgaagtagaagcatgttgtttgatccatatcatacctcgtctttgggggagtatgttccccctctttgctttccaacttttatgttctggttttggagcccagattgaggtaattttatacaaatgcaggtgtttcttttaagattactgtagattatttttcttgtttagatacatttacagtagctctttttactaccttattagctagctgatttcctttgctttctggagtgtttgatttagaatggcctggaattttaattatggccagtgactttggtaataatatggctcccaacaattgtgaaatgaggtgtccattttttatggattgaccagaagaggtgaaaaatcctctgtttccatagcattccaaaatcatgagctactctgaaagcatatttactgaatattagtaatgaatattatcaacaattattcctttcgccaactgacaaaccctgatcaatgcaattctgcttgttgatgtgaggtggcttctggaaggtaagcctttctatttcttcagttgaagatactgttgtgtaacctgctcggtaagtccctgatccatcctttaaataagagctgcctgtaactcaaacaacatcagcattaatcagtggagtctcttgcaagtcagtcctaggaaagaggagccaatcaactggggctatgtgattatgcagtgtttcatctgaaaatgaaggcagaagagtgtcaggatttaggttacacctggagatggtgataggagaagctgaaagaagtaaaactcatgtgaagctcgtctactaattgaataatgtccagtgtggtgtgagtttagtgatgcttccacagaatgagggataaaaacagtaaggggagttcccaccacagttccttgggtcatcttaatgaacaaggtggttgctgttatatctctcatgcaaagaggcaatcctttggctaccgggcctaactgttggctgtaatgccctacaggtctatttcagccttcatgtttctgagtcagattatctaaagcatttccatcattttcatgtacaaacaatgaaaatgtgaggttataatttacatgccccaaagaagaggcattggcaagaccattcttagtcatttctaatgttagttgactttcttttatccagtctagagggtttaaagttctctattaagagggcatataaggaaggtgggcgcagtggctcatgcctgtaatcccaggactttgggaggccaagatgggtggatcaatgaaggtcgggagttcaagactagcctggccaacatggtgaaaccccgtctcaagtaaaaatacaaaaattagccaagtgagactctgtcttaaaaacaaaaaggagggcatataaggattgggcttttaaataaaaatttggaatccaatttctacaatatcctgccagtcctaaaatcccactcaaccatctcttcattcttggttgtaaaaagctgagatcctttctagtctgtctgaattaataaaacatccttccttggatattaggtggcctaagtatatcacttgtcttcgacaaaattgaagtttctctttagagactttgttttcttagggctgccttttgtaataaatgtagcccatcattcacagaacatcttgtttgctctccaagatggaagtcatttatttactggattaatgtatgcatttccaggaaattaacatctgagaggcctatttttaatatttttgaaaagtaagtcaggctttcagcatatccttggaggcctgtgtgacccagtgtattgtctgttttcccaagtgaaggcaaagagaaattggctatttttgtctacaagaatgctaaagaatgtactacataagtctatgactgtaaggaattccacattagaaggaatggctgtgagtaacataggcttgtgcagtatagggtgccatgggattgccatgttgtttattgctctcaagtcttgtacaaacctccattctctaacatttggttttcttaccaggaggattggggtattacaatggcttgtacaaggaatgaacagtcatctttctatataatctgacattataagctttatccctcctagagctttagttctcaaggggtattgtcttgtattttgaagatgtttccatgggtatatttaaatatttattggagtagctgagatgatagtttctatatcaatggaggacactgaccacaatggatcaagtactgtctttagtacattttgtaattcttcattaagcaataattcattgtctttcatggcaatatggattgcaattggattagattttgaaaattttattaaaatatctgttgtgtctcaaagttgagttttataatctaattttaaatatatttccttcctttgagagaaagaaatgtgggtatcacataattctaagcagtttcttcctgttgaatggatggggtctgatggaacaaagaggagggcatgagttccttgtaacgaacactgttgaaaggttacaggctgagattggtatgccaatacaggaggattgtgatgcccaccatttgaattctttgtttactgcaaggaatgggaccttgtaccaagatgggattaattccagataatgtggctccagtgtcaataagtgcttgtgttagttctccatttataataatttttatttctcccagtgttagtaaggaggaaatgaaaggcccctttaagttccttggagcacccctgttttcttttctgcctccactggttaacattctttcctttttcatttttggcaactcttttgaaagtaatcatgctttttgcaaaaattgcaaagtggaaggttaggtccattagggagtttctaggggtattgtgaaggccaaaattgtgtgaatagttgttttaattgtaaattcataattgtattagcctcgctcttttgtttggcttccctctctctttcttcttcagttaaggtatcagataaccggtcaatgagactgaccaaatcatgagtatcagaagtggcccaactttgtcttttcattgttagttccaattcatctaactcatttgttaaactggagtcgagtatcatttcgatgattagcacagctttcttcggataaaactaaatattctttaaaattttttccacagccctcaaagtatattactgactcatctgaattttgttgatattgtattttgttccagttgactactctgaaaaactgaggagatagcctgatgcaaagcctttgctgttcttcaagcctgtctatggtcctcttctgaacatttatgaagatccctaacagatttctccagtgagctttgtctagccagcctttagctttaatttttgctactaacatgtgaatctgttgctagaagtcagaataactagggtcataagcttggatatttaattcaaatttcctagcaaaaccaataggaacctggtgaagatcaaggaattcttttaactatgcctgtaagtttgatcatgattgataaagcaggttcccctctaccagatgctggatgaaatggagccaaaccagtgggagcaggaggaggggcaggaggaggaggaggagaaggtcaatcagggctgggtagttctgacaaggaggcttagagagacaggggagcagggagagaagaagacatttcagtgttttttaaaattcagtaatggttttagagtgctttttattttcttcctctaagggaagaattctgtcaaaacctcttttggatgcttctgggtgccattggaagtaactctcttaattattttatttgattccatagctggctttttaaaattgtgcatataaataaactaatctagctatttcaaagataattctctttgatcattgtaatttaggatcttcttaggtcaaataagaccatttctccaactatcgacaggaggtggcgccataagtcttgtacataaaccccgctggagtttccaaaggtgcattgcttaatgagggcttggttatagatggataattgctcataatttggattctcttttaaaatgcccaaaggctaaaagggaaaagtgtttggggtccagtgtgctgcttagtagggattattcctggaggtatcacctacaagtagcttcttccctcttacctacctcagagaaacccagacatttctgggagttcaaggcactgggtgacgaaccccttgtgtgttgtgtgccccgggggttaagcagctctccctgtgagttcttctctggggtttgttgtgagcttccacacccttgtgttacctccattgcctaaggtgcctttcagctgggagaaagagtcctttttgtcttcagcttatcacgtcctcattccaaccttttacaaattttgggtgactcaggaagaaactttaaatctcaatgttaaccaagatccaaagcctggctggtttaaagccacaaatttggcttaagccacaaacattcactttctccttttacaaagaaaactgctttctctttaaccaaatgtcaaatgagagaaaaggttacaaacttgagcaagtaaaaaaatgtccaatgagagaaaaggttacaaacttgagcaagtaaaatgtccaatgagagaaaaggttacaaaagagcaagtaagacgaacgaaaacttaacctaatagaaaagtgaaaccacaaacctgccaatagcagaatctttagagaaatgacgcgaaactcctgccttaaagccctaaatggcggcttcaatatcagtcccactgagcatgaaattcatttacttaaataaaatctgaatctcagcccaaacctgggagattcaaaacctgagagcggtcttaccaaagacgcccgtatgtctggtgaagtcagttggatgcaagcagtttgtgctggtaccagggccccagctactgatgaagtggcaggagtccacagaagcctacttcgaagttcccggggcttccaggggaggtgagaacacaagtgatgggagagcctggggagggactgtctggtgagtaaaggttgtgctgctctgtggatgaaatgtctctgaggtcgtaaacatctcagagccgccttcgggagaacgggtgatagtcatctgggctgatgtcacctccagtgtcctctcctgtgatctgtgttaatcctcccagattgacgagattcctggggaggcgattcatgacagctgagttccttttggaggatccgtcttcaggcaggtaaggggagctcagaggaaacctctgcctgcatccgctgattcccaagtgccctcagctcacagggatcagcactcccaagtgccatgggggtggcatttcctgaactccttcaaagcaataacaacaggctgggcgtggtggcttacgcctgtaatcccagcactttaggaggctgaagtgtgaggattgcttgaagccaggagttcaagaccagcctgggcaacatagggaaaccctgtctctacaaagaattaaaagaaaacttagccaggaatggcagtgcacacatgtggccccgcctactcgggagactgaggtgggaggagtgcttgagccaggtggttgaggctgcagggagctgtgattgcaccactgcactccagcctgggcaacagagtgagactctatctcaaaacaaacaaacaacaacaacaaaagtgaaacaataacaacaacttttacaaaacggacatttgggatctacatgccacactcctaaatgcgtctcttaagcaacaggtgtcacagtcttaaaccttgtccttaccctcttcattctaggcacctgtttcattccaggtagggcttcctcctggtttcctaacacagcgggttgagatgaacagcagagaaggacactgcacacctctgcagggtctcccctctggcccaccagccctcccttctccagcagtgaagacctcactatgtcatccaggcaggaataatatagacagaaaccccagaagccccaaagctctgaagcctaaaccacaagccccacgaagttccacagggcccactgggcagaatggcgtgaaccttcagggtttgtttggttttatgaaccatttagtcattctttctccttcctcccatggtagcactaaaatacattctcaggctcccaggtatatacaggggggacggagaggcgaggatattcctgattggaaaacaaaacaaaacctacctttactaatctcaatatacagattaggctaatcagattaaataattctgaaagttttcaaaatgtcattgttagatttttcattattttagagaagaggtcttactctgttgcccaagctggactcaaactcctgggctcaagcgaacctcctgcctcagcctcctgagtagctggactacaggtgcgcaccaccatgcctggctgaaattggtttttattgagggtcttgatatgaaaaaaaagtctttgaatcttaatgttactttttcatttcttcttggcaaccaaagcatccatgttttaatttttctttgtttattgttggctggagagcactgccttcctcatgtaccatgcatcaagccctctccccagcctgaagaacaccatgttcctcttagcgatcatcagtaacaaggcgtgccactcgaagaactacaaagataagggtttggggtttgtgctggggaaagctcatgacactagctgcaggaatagaggactgagcctcccaagtcctggaaagcagagggaggatgccccgctctgatttcctcagcacctttgcagagctcttggtctcctgcctgtgccctgcaggcctgactcaccttcctctctgcacgtgagactctgcacacctcctatcgtgtttattgacgcatggcagcctcagccctccatttcatgtgacctcccagctttgctctctacaacacctaacccagtcagtttctgtgtcctaattcaaaattgctgggagaaaaaaaagtctgattggcatttgagtttgagaacgaaggcttgaaagagccagtttgaagaatgggagcaaggcctggctagagcactgatcgacaaacttttcctgtaaagggctgggtagtagatattgcaggctttgcaggccatgaaatccacgctgcattgtagtggcatgcaagctgccatagccaatctgtaaatgaatgagtgtggctgggtcgcattagcattttatttccaaaaatagcaggtggccagatttggcccagggactataattttccaattcctgagatactagaaacagaagtgttttgttgttgttttaactaactctttattgaagtacagcaaacaaaagtatacacattatagcattgtatgaactatcacagagtgactacacgcatgtaaccaccaactgtgtgaagaaaacattgcctgcatcccagaaactatgtatgcacccttactagtcactaatctcacactcctccccaaaagtaactaaaactctgatttgtattgtcagtggtttctcctgttttggactttatataaatgaagtcatattgtatgtatttctactttctgtctaacttctttgtatgatattctcccagtggaattcatctgtattgtggtttgtaccaatggttcatttctttttattgttattataatattttattgcattactataatagtatttatttcattctactgtagatggacatttaacattgtttctagtttggggctgctgcatgtctttggatgaatatgtgtacacatttttgttggaaatagaattgctggtccaacatagatagatagataggtaggtagatacatagatagatagatagatttattattgaatatatataacaaaatgttcttattgttcatcataatttccaaatgacattttttttctatttggtgtggaataactttcatatcttccattaatttttttagacatagttcttttatttgaacatgtttttgatacctggtttaatgtctttgtctaataagtccaacatctgggcttactctgggacaatttcttttgactacttttttatgtttataggccatacttgcctgttcttttgtgtgtctcctaattatttggttgaaaactagacactttaaataatatatcgactctggaaattagagttgttgctgtttttgtgattgctgttgtggtggtggtttatttgtttagtgatgtttctggattggtattgtaaagtctgtattcttttttgtgtgcagccactaaagtatttacttggttagcttagtggtcagctaatgattggacagagaattccttaaatgccttcaaccaataagcctccccttgctcatgggctgtttgttagggtatgtcttcaatgtccctgcaattcacaactccaccttagtcttcactcctgcttgatcagaccctcaagagccactggagtaagtacttagggccttcctggtctctcttgggcctgcatgcagccgtgcacacaggaggccttctaatcccccaggaataagttggagcttttcaaagcccctaagaatatctctgtccctagactttccttgtaagttttatatccaatttcttttttctttcttttttttttttttttttgagacggtgtctcgctctgtcacccaggctggagtgcagtggcacgatcttggctcactgtaagctccacctcctgggttcacgccattctcctgcctcagcctcccgagtagctgggaccacatgtgcccaccaccacgcctggctaattttttgtatttttagtagagacagggtttcaccattttagccaggatggtctcgaactcctgaccttgtgatcctcccgccttggcctcccaaagtgctgggattacaggtgtgagccaccatgcccggccttttatatccaatttcttatctgccctaagtggcaccaccacttttgacagctgggatgttgaacagttagtgctgattgattttcacaaacaccctggggatggggctttcctcactgggagatctgaatcaggtcaaataaaggtgagccttgtgaatggggcttgaataggagctgccagcccaggagaaagattgatgattctctgggaatgaggtttttggggctctgaagctgtcctgcccctctagtccgtccattaggctgttggttttcactactaccacagttccaaggctgctgtttttcaaggctgctgcagagctgatggtggttgagggggtgggactggggaagaggcaaagttaaaattccacaaagcctgctgtttactgagtttcagccattttctttaactaacactctgaattgttccaatcctattgttaatatccagagttctgaaaaagtggattttgacagcttatgctacgtcccttctcttacggaggcacagattcttggagggccctccaccatcagttcacacatccttctccaggcattatggctggtggtttttattttttaccatggtaaattttaaatcttttctaggccaaatttttttttagtatgataaaagacacagaaaaaaaagcatacacacacacacagtaacacacatacacagaggtacattggcctattatttaattctatatgtggatgttgggttttgtgttagtctgttctcatgctgttgtaaagaactgccaaagactgggtaatttataaatgaaagaggtttaattgactgacagttcaacagggcttgggaggcctcaggaaacttacaatcatggtggaaggtgaagcaaatatgtccttcttcacatggcagcaggaaggggaagcatcgagcaaagagggaacagccccttataaaaccatcacatctcatgagaactcactcaatattatgagaacagcatgggggtaactgctcccatgattcaattacttccaactgggtccctcccccaacatgtggggattacaattcaagatgagatttgggtggggacacagacccagaccatattatacacactggcccctctcaaatcttgtctttctcacatttcaaaacacaattatgtcttcccagtgatttcccaaactcttcagtcatttcagcgttaaccccaaagcccaagtccatagtatcttctgagacaaggcaagtcccttccacctatgagcctgtaaaatcaaaagcaagttagttacgtcctagataaatgcgggtacaagcattgggtaaatacgcctgttccaaatggaagaaattggccaaaatgaaggggctacaggccccatgcaactctgaaatcaaatagggcagtcatcaaaccttaatgcaccaaaatgatctcttttgactccaggtcttacatacaggtcacgctgatgcaagaggtaggctcccacagccttgggcagctctgcccctgtggttttgcagggtacagccccccaccccccgccagctgctttcacggcaggctttgagtgtctttggcttttccaggtgcatggtgcaagctatcagtggatctaccattctggggtctggaggatggtgaccctcttctcacagctccactaggcaatgcctcagtggggatgctgtgtgggggctctgaccccacatttcccttcagcactgccctagcagaggttctccatgagggctccacccctgcagcagacttctgcctggacatccaggcgtttccatacatactctgaaatctaggtgaaggtccccaaacctcaattcttgtctaatgcacacctgagggactaacaccatgtggaagctgccaaagcttggggcttcaccctctgaagcaattgcctgagcatgtatcttggccccttttagccgcagctagagctgaagcagctgggatgcattgcaactagtcctcaggatgcgcacagcaggggggccctggacctggcccatgaaaccatttttgcctcctagacctccaggcctgtgataggaggggctgctgcaaaggtctctgacatcccccagagacattttccccattgtcttggtgattaacatttggctcctcgttacttatgcaaatttctgcaactggcttaaatttctccccagaaaatgagtttttcttttctaccgcattgtcaagctgcaaatttcccaaactttatgctctgtcacctcttgaatgctttgctttagaagtcaaaattctaaaacagaattctaaagaaatttctaaagttcagaaatttcttccatcagataccctaaatcatccctctctagttcagatatctagggcaggggcaaaatgccaccagtctctttggtaaactatagcaagagtcaacttcattctagttcccaacaagttcttcacctccatctgacaccacctcagcctggacttcattgtccacctcactatcagcattttggtcaaaaccattcaataagtctctaggaagtttcaaactttcgcatatctccttgtcgtctgaaccctccaagtatctaggaagttccaaactttcccacattttcctgtcttcttctgagccctccaaactgtttcaatctctgtctattaccagttccaaagttgtttccacattttttgagtatccttatagcagcaccttactctgtggtaccaatttactgtattagcctattcttacactgctataatgaactgctggagactgggtaatttataaaggaaaaggtttgacttatacttccacagggctggggaggcctcgagaaacttacaatcatggcagaagttgaagcaaacacgtccatcttcacatggtgcccaaaaggagaagtgttgagcaaaggggaaaaagccccttataaaaccatcagatctcatgcgaacacactcactatcatgagaatagcatgggggtaactgctcccatgatttatttacctcccaccaagtccctgccccaacacgtggggattacatttcaggttacaattcaagataagattcgggtggggacacaaagacagaccatatcaggttttgaacacaaggtttaagagaagtttaaagaaagtcctgtggaagagctaaatatgaattcccaacagaatctccccttggccaacctccttgtcatcagttcactggctaaactagtgctctgcatttccttgtttttaaattgtgatgaaatatacacaatacagaacttaacacgttaaccatttttaagtgtacaggtttgttacttttaagtgcattcacattgttgtgcagtcatcaccacctcatctccattacttttttcatcttaaaactgaaactctatgcccattacataactctccacgcttctcccagcccctggaaaccaccattctactttctgtgtctttatatttgactactctaggaacctcatgcaagtggaatcatacattatctgccttttgtgactgatttctttcacttagcattatattttgaagtgtaggataaatcatacactatgtgtcttttgtaactgatttctttcacttagcaatatatttcaaaggttcatccatgttgtagtgtgtgttagaattttcttcctttttaaggctgagtgatatttttaaggctgaatgatatgcccttgtatgaatagaacacatttgtttattcattcatctaatgatgaacacctggtttgcttccaccttttgtctattgtgaatgctgctactataaacatgggcttacaaatatcttgaggagcccctgctttcaattgttttgggtatatacccagaagtgggattgctaaatcatatgttgatactatttttaattttttgagggcatgctatactgttttccattttacattcccaacagcagtgcacacatgtccaatttctccaaatcctcacctacatgtgttatttcctgcttttttttgacagtagttattctaatgagtgtggagttgttagggtccagcctcaacgccacccacgggtacccaaagtttggtggcggcaaaggaatgagaagagacaagttaagagtgaaaggtggggagctgggggccagtgcaaaatgtggaggctgcaaaaggctcagagctctggtttccacactatttattgagtacaatcacttagatctgagaagcaggggttcaggggtgaaatggggaaaggcagacagtgcgttatacgtgtaatgtatagcagtggcggtttaagtgaatctcctttgtgctcaaatagtatatctttagttacttgttgggaccgggcttaactaggagcctgcatatctagccacattctaatgcttcataggagtgtctttctccttgaacacagtgtttatggataagagagcaagtcttgctcagagcatgggaacatagtggctataagaaggctttcttcttcagaggcctcttgtggctttccgcaacttattgtctcatatttttatggccagtttatgcaggcaccccataagcctttctcccaacatggagtggtattttattgtgactttaattcacatttctctaatgattggtgacactgagctttcttttttttcatgtgcttattgtccatttatatgccttctttggagaaatgtctatttcaagtctcttacccattttttaattaagttgattcttagctgttgagtcataggagttccttatatattccagatattaatcctttatcagatatatgatttgcaaacattctttcccatctgatgggttgccttttcactctgttgtcttttaatatataaacattttacattttggtgtagcccaatttatattttcttttgttgtctatgcatttggtgttgtatccaagaagtcactgccaaatccaatatcatgaagcttttctatgttgtcttctaagagttttatagttttagttcttagctttaggactttgattcattttgagttcatttttgcacatggtgaaaggtaatgttccagcaacatccttttgcatgtgggtatccagttttttccagtagcatttgttagaatgactgtcctttctcccattgaaaatcttagcacccttgccaaaaatcatttggccctatgtgcaaaggtttatttcaggactctctattttatttcagtggtcaataagtctttatgccaacatcatgctgtcttgattgctgtcactttataatattttgaaatcaggaagtgagacttccaactttgttctcctttttcaagattatttttgctgttcactcttaagattccatgtgaattttatggtcaagttttctatttctggaaaaaacgtcattgagattttgatagggattgcattgaaaccatagattgctttggttggtattgacatcttaacaatatcaagtcttccaatccatgaacatgggatgtctttccatttattggtatcttctttaatttcttttatcaatattttgtagttttcagcatacacatctttcacctccttggttaagtttattcccaagtattttattctttttaatgctattgtaaatggaattgttttaattaccttttcagactgttcattgttagtatataaaaacacaactgattttcgtgttgactttgtattttctggtttattagttctgtcaggttggtgtttttgtttgttctggtggtatctttagggtttctacatacctttagggtttgctacatataagatcatgtcacctgtgaactaccccattaagctttatattttaattatattttatttctacatgttccttttgatactttttcaaatctgctgggtcattcttcatagtttcttatttcctgctaatattttaagcctgcctcaggagatattaactctgttgtgttctctcataattccaaattatgtggctctatttcctatttctgtgtctggtgtgtgcccatttttgttcatgatgccttgcttccttgctattttctctgtgggataagtatgtgtttagtccaagatggggaggggggtatctccaaggaggatttgtaattccttatgcaattgctttagggtgctactagcctaaattctgaggttgaagggtttttggaccatccacgtattgtgaattagtgcagcagccctaaggttcaagactggcagtgactcccagggttgttgggggcagatttatgtttatttctatttcatatttatacctagggcatagccctttggggttccagtcttagggaaggaggatcttctatttcactcctcactttgggcaggtcctgaacacttaccttctccacagtgaggctgtgaaactcaagttcagctgcttggacaaatgctctcaaggcaatggcctcagtgcttagctagtccctgagttttcatctttacttagttcttggcctgagtactcctgttttgccagctcatgggtttattttctatatctaaggtcaccatttttcattatcagaaggataactagtcaaggtagctgcccaccatattgccagagatacaaatgtctccctgaacacttgaggtctcataccatcaaaattctcatctcaccttgtcaaccattcctttgatatcttccactgaccactgagaattggtcttcaagccccagtccttggcagtacaaagggtaattagggagtgttgacctacaattacctaatgccactatgataactccccagtaacggaactcagcttacatgcttacccaaattgcagccttaatttcactataaaattttctctggctgccttaccaagttcattgtttatatcattatcactaatttcttttctccaaatgtaaaatttttagtttaaatcatgaacaaagcgatgttgttttcctttgaaacaccccctttttctctaagtctatcctaattccaggtcttactacttcttatagaggtgaatccaacatgttttgttcacttacctgccttcactgtgtctactttcaaattaatctttctggaatagtttttattatatcccctccccccacaaaaaattaaaactattccttattttccctctgataattttagttcaacacattttgagcaaatgcctataaaatgccaagcaatctacaaaaatttgggatactgtcagttttctattgctgctgtaacaaattgccacaaatttagtggcttaaatgagaacaactaaaaactattgttttacagttctataggtcagaagtctggtggagtctcattggagtaaaatcactcttagttccttgcatctgtaggactaaggtcccattttccaaaccactttcctgtcttcctcttccactgtgaggggttcacgtgattcactcgggccttcctggataattctgccttcctcttccactgtgaggggttcacatggctcgcttgggccttcctggataatgcaggctcatcgccccatctcaaggtcctcaaccttaatcacacctgcaaagtatcttttgccactaagctaacatagaagccacaggttctggggattaggtctaggacagggattccccagcccccaggtcacgtaccagtacgagtccacggcctattaggaactgggctgcacagcagctgagaggtgggcgagtgagcattaccgcctgagctctgcctcgtatcagatgactggcagcattagattctcatgggagcacgaactctattgtgaactgcacatgccaagcatctgggttgcgtacttcttatgagaatctaatgcctgaagatctgaggttgaacagtttcatcctgaaacataccctaaacccctacccaatctatgggaaaattatcttccatgaaaccactccctggtgccaaaaaggtaaggggctgctggtctagggtatctttggggggctataattccacctaccacagataacataggtgaagaaggcctcaatctgtctctgaggcttcattaacgcagagagaaacagagtgcgaacaagtaaccactcacctctaagacatctattccattgtatcagagagggctgaggacacaaagaggaggaaactagaaagaatgtttataaagatcaggaaggccttacagtctaaatgaggggaaagcttgccagataggaatgggagttcttctaataggaagagatagcatataaagtgagagaggcctgtgaagtgtttggcaagcttgggtaatcacaactgattccatgtgactaatgggagtaagggggtgggatggtgacattacaagagattaagatgctggccgtggtggcacgcacctgtagtcccagctgtttggaaggctgaggcacgagaatcgcttgggcccgggaggtggaagttgcagtgagccaagatcatgccactgcactccagctagcactagagtgagactcgatctcaaaaaaaaaaaaaaaaagaaaaagatgtgaaacatctcatcttggactctttctttttagcattaatatgagaaacagaatcttatttcaggaaaattactcctggaacagtacagaggtcaacctgaaaggaaagcgactggagaaaaggagacaaatgtaaaaccttgctaacatttacaagaggaaaagaaatgaacacagtgagcgtggggagaggtagatatgaacagctctgcagttggaggaacaaaccttggaaataaggagaggtgacctgtgtttagctgcacccctagagggtggaatcggctgaggagcaagcccagcaacactgaagttcagagatggagcggctgggcggtgggcgagagaaactcttcggggacacatgtggttcatttcaggaggtagctaaactttctacaaagttagtacgtaattacacacttattttttaattcaacaaagtaatttgggagagcttcatggggagcagcactgaggtttaaagagctgaggatacaattatcttcatttaactttctatgctaaaatatttcttaaaaataaagttgtgcagctattactattcaaatatttccttaaattaccaaatatttgctagattgacatatgttgtttaacttttcctaatgagactaaactcctagagctaggatacgcagtatttcttccaagtttcctctcaatacctagcagatagattaaaaacacactttttgtgagctatcaggtagatacttttaattatcctacacaaagaaacaatcttgggatgatttggatggattatctatgtcttcatcattggcattcacattgcttgccattcttacttgccagtgttacagaattcagggtatactgaggtggcagctcggtgatggacagctgttcatcttctcaatgatcagccacccctggtcactgcacgctggaaaagtacctagtgcaagggaaggacctccattttttaattgcactttatgttaacttcaaaactggcattaattcagttattggaagacacttaactatcttttgaataatttgagtatataaacatacataatatcctttttcaactctaagtggtgtgaaatctaaacagatcaagtacttccaatgaaaatttcagaattgagatgttgtctaagtgtaaaatatacactggattttaaagacttggcatccctcaaacagtaaaaatatctcagtaatttctaaaaatattgattacttctggcagaagcaatatttggatgtattgtctacatattaaaactaattttaaaacatttattgtagctactaaaaatgtttaaattacacattgttcccattatatttctattagatgacaccgagccagatgaaaataggattaaatgagattttcatgtaagaaataatttgtccgatctaatcatttttttctaagaagtatttacttgaaatctttttatttttatatgttcatctaagtccctcttagtcaccaaatcaatgcttaacagctgtgcaagccagttggctttagacagctcctggagtttttaaggatcatttcttggcagctttagaaaaaaaagcactaattgaaaggttaatcaaatcagtcatatttgtatgttggttatataaacaccctgtctccaccaaagattaaacagacgcattatactctacccagaaggcccatttattctgtaatgattgtcacttgccttcaagcttctaagtagtagggaagtactttgaatactttgcaaatgaaaactctattctgatttatgaaatgcttccacactgccaggattctacagaatctaaaatattttatagcaacaccaattctacctgtggtacacaaggggaaaaggtcagttctacatctactcaaagataagtcagtatctaagtttatttaagcacaaaaatataagcttaaaaatagacatattttgaggcacaatgttggttaaaaaacagctctgaatgtctgcgacagcactggtcagcacgatctaaagatattagcagttactgccctgctcatctttaataaacaggcggtctcctaccattttatcacacctatgatccaacaagacgtgtactgcaacagggtctggaaagaagcaggatggatgcaagttccgtagcgtcactggttctcactggttgcgcctgtgcttagtgattgcaaaataatctgaatccacccctgcctgggatggagtttattacggtgacaaaaaaaatggctggcttctagaaattatttcttgaggtaaaaattgactggaaaatattttgtcttgaaattacttaaaatgtgatccggtttgatgcaaattataagttatgcaaaaaatgtggaataataaaggattactcaattctaagttcaaaagtacatttatttaaaatgtgggcaagatatcaatataaaagaaaacagagtataagaaataaaaataatcaaagtacaaaacatttcaaatctttaacatccataatttagagatagcaaggtctttatttacaccattttatttctagttgaagtcccgtaacagttttgtgaaaacatttaaaaacctggcaaatgaatcataaaacctaatgtgggctcttaaagtcatataatacaaaacataatttatgtttcctcagaataaaattgcacatcttaaaaagatgcagtatatttattatatctgtcttcctgcttcacagtctgatcccccaggaaagcagctggaaaacaagagcatgtgaaggaagcgcagcagctcctcgccagccagacagccagccccgcaccgcaggagtcgacatgcacggcagcctagacgccatcagttaaacttatatgtaggcttgttgaggaaaacgactttcaaacacaaggcaaaagaaaaacatgaaaccaagggttccaacattcatcatccagtttcagagacacccttgaaggaatgctacagcctctttcttacccattcaaaccagtcgctctgctgcatacccacatcacaggaggccctcagccccgacacacaggctcactcagcccggggacatcagcacctgtgccagctccgcaaggtatccaccatgcggccagaactgaggcccagcaatagctgaaatgtcctttaaattaacatgtacaacacacaacccccaagagctgacatccccaaagccccaccacaaatagctgactcctacttatacctgcaggagcaggtagtgacctctgcaattctaaaccgtccactttgggcaaaattcatcaagctatggatatgaaaaaaggcccccaaggtaatactcataagtctcctgtatgacttttaaagcaatttcttctgaaagtaaatgtagtgtagaacaggctttcacaaatacaaacatgaatgttaggaaaaagtctggaaaaaatgcaagagtacatgttgtataaaaaccaaatgcttatagcatatctgtaaaaatttaacaggcctcttatcattcctatcagtagctcctacaataattttctaatagatggcggtatggaatacagcaagctctggtatgaatggtaagagcgtttctgcaccaagcctcattccaactagacaggctatttatttatggctaaacatgacattggattctgggactgaggcaaattttacttctttttttttttttttttttttaaagacagagtttcgctcttgttgcccaggctgtagtgcaatggcgcgatattggctcactgcaacccctgcctcccaggttcaagtgattctcctgcctcaccaagtagctgtgattacaggtacccgccaccatggccagctaattttttctatttttagtagagccagggtttcaccatgttggccaggctggtctcgaactcctgatctcaggtgatccacctgtcttggcctcccgtgctgggattataggcatgagccaccacgtccggccaaattttacttcttaaaagtgcttttctctcagtgatatcaaggtcttctgtctactattataaccataagctctttagcgttaagaggaaaatgtttgataaatgtaattaactggatgaatgtcagtgtatttaaatgtaaatatacttaaatgtaattacctggatgaaacaggcacacacgaagaaaaaaaaactcggcaaggatgggtatcattctgacctctgcgccttactgaagcagtcctatcccaaacacaaaattcccctgcttaaggaaaggtccactgaggttgacactggtcagaggtggcagaggctcccaccctcacagagaggaggagctccagcctcattgcaggaggcccagggagaagtcctgagaacagccctgagagaaggtgctctgcaatgggaaacggaagtggaaacagaattttcccataaggacctgtaaggcatgttttgcttcactgataggctgttcctacattaaaataataattcagagatttttaataaggaattcaaataacagatgatgagctttattttttcctgaatgtctgaaatagaaaaaagcctaggtgtcaatattctaaagactgacctttgcattttcctgacatgttgatgaagtattcattctgccgcttccatttagtagtaatttatctcccatcccaaagttcctgagtacaaagactatatacgaactaaatttcatttggaaaactacaaactcaaaggtgagctgataaaaagaaacatatatttatttttgcaattattttctattttatctaattgtcaaattctttaatacctccataaactagacagtatagatcctttctaattaacatcacctattaaaactgaactctcagtaagttaagagaatatttttactagcaactcaaatgaatattctgaagagaaaagaattgttcactgcataaatcacaatagcaaagaaaggaaaaatggcttgcaaaacaggaaaggtactgccttattaacctgggaaatccatttcatatctaacccgtctactttttaattctcttttggaaaggatatgattcatagtccagcgtttgagtgagcactccagtcagaacgaactctgcattgtgaacatctgaacagggtggaaacagacactttagttagagatccactgctgtgcgtgcacacatactcacacaggtaagcggggaaacgtacctatgcctctggcaaaatattctcggcataaatgaaggtcattttcacaggatattaaaattatttccgacaaactctaaggaaaagaaaatgagtttctcagtgaccgaacgctgaatgtgatacagggcaatgacggactcgctggcggactccactctacccaccgagttctgcttgtgctccatgagcttccggaaagatggctgcttggataacacctttcctcctgcacactctacgattgccttcatagtggaaagacttgggcagattccaggtgtgatgtaaaaatattttgcctaaaattaaatgaaaatatatgtattatgttcttaaaatgctttaatttttagagtacataattctcatagattctgccctgagatttttgacaaaatttcaaattttatgacattatgaaggtactattctcctactagcactcaatctgaagtggaagaggaatccagctatgtaaatttggaatgtaagcattttcacatgttaagtatgcctgaagatgatttaaagtaaccagaacttaagtccctaaaacaaagtgttttgtgaataagcaagaatattacaaatatttttcacaatttctatacaattttaaatcagcattatatttcaccacacttatctgcccagcaacagcctctggcatagcatgctgcctggcttatatcccttttctttattttctccatattatttgaactcagagcaggaaatgatattgatgcttaagatttaattatctaacaagattgctcctgaggataccacaaaatactattctgtctgaaactgcaaataatttctaattcctgttgactccttaagaaggttaaagaaccgattatctttattgatttacttagttctttggtacaaaaaaaattcctagctgttctaacacttatctaacatttaaaaatcttttagtactgaattatatctatgcacacactgaatattttcccaagtatcttctccagctgaatatacatttactgacaatagtacgaagtaagcgatgtcctctaaagatttattaaaagcagaaaaatgaacatgcctcttaaccaattactcaaaaacctattctttgaataacttatttctcatagatgtatttattaaatttgtgtacttatttttaaacattatagtaaagaaaagttctctagagatgtgctgtggttcacaggaggaagacctccagtggcaatgtccaagaaggaagccaagaggtaaatgggatgcagggtgagcccagctcccctggaggcgcacttcccaccaaatcacctggtagttcccttgagcaggtccgtgtgttatgcttacttggactgatttacttttcccttaaagtgtaccttaaagagtggagaaacgtgtgcccgttttaaggattcttccaagctgaaagagaaaagtacttctgcctcagcatctcggagaatgtagttctgctcatctggaaaacagaacagcacatactctgaaaagtgtggacacgtgaagtgtggcaagtgtgacccacaaaattctcgcccatattcaggtacataatattacagctacatttacctgtacagccttcggatatttaaatgtcaccattatatttcatttacttccctctaaaaacagccagaccaaaaagacagacaggtattttttctcctagatcagtggtaattaaccatttggggtcataaactcttgaaaaaaacgggctgggtgtggtggttcatgcctgtaattccagcactttgggaagccggggaaggaaagctgcttgatgccaggagttcgagaacagcctgggcaacacagtgagacttcatctctacagaaaaattttaaaatcagcttggcatggtggcatgtgcctgtagtcccagctactcgggggactgaagtgggaggatcgcttgagtctgggaagttcgaggctgtggtgagccatcattgcaccacagcaccccagcctgggcaacaaagtgagatctggtctcaaaataatagtaatttttttttttttaacaacaaaaatgtaaaaaaagaaaaaaaaaattactgaaaaatatgaaccctcttcccatagctgctcctcccctctttaccccccgactattttaggaagttcaccaactttccaagcccgcagatctcaggttaaaatctccagtcctagaaagacaagcttcaaataatcccatccaagtgtatattatatatatatatgttatatatatacactaactcctcaaggacttgtaggacattggagtcatttggctcataatcaattatgtgaattaccaaactttaaagatttaccaaacacacattcaagtatataaaagtatacagcaatttataaaggatagttttatcaatttttaaagacttctgacaattattaataattgacagattttcagttttcatagcaacattttaagaaatgtgtcaaaaggtaaagatcacaaaatgtttcaatcttcctataaatatgcctcatattcagaaaaccatttctcctccgccgccatttcctaccaaccatacagcataataaggcagctcaaacccaataatatatacatcaaaagcagaaaacaaggaaaagtgatttgggattggcaaactggggttgacaagatgatacatattttaggatttgtgggctatgtattatttctcctgcatattcctcttctcttttttaagcaatatttaaaaaatgtaaaaaccattttcagcgtatggaccagtttgctgactgctgggcaggagcaaccacatcatgacagaaatgcagggatctgttcaccaacggccagaaatacaaaatcaatccctgagtcaaccagcagatagaaaggctgctttttaggtgaaaggagaaaaagaatgtctaaaatttggaaaaacaaaaaatgatgaattaaaaaaggaacaaaaaaagtactgttacacatgagatggtatatttgaagtgttactttcaaagctgatatgccttctgaagaacttgtgtgagatcaccaagaatagttaatgtttatgatagagaaaacaccaccgggcgcggtggctcacgcctataatcccagcactttgggaggccgaggtgggcggatctcttgaggtcaggagttcaagaccagcctggccaacatggtgaaaccctgtctctactaaaaaatacaaaaaaatttagccaggcgtcgtcgtggtgggcgcctgcagtcccagctactagggaggctgaggcaggagaatggcttgaacccaggaggcagaggttgtagtaagccaatggcaccactctactccagcctgagcaacagactgggtgagactctgtcttaaaaagaaaagaaagtaatattgaaaaatacagtaatacagctaagacgatcctgtcacagatgagacattgagattttggttttttcaaacagggttatgttaccttagtagtagcaatgtaaagactcaacctgaacattaaacttttcatggaagtacaaaagaaatgagtatcctagaaattgattataatattgatgtctcaaattttatgtaagttacacataaatataaaatcccaaaaacatgcacctaccaaaacaggtggagaaaagagtgttttcaacaaatgatgctggaacaactgcacatccatatgcaataaaaggaagctggacacagactttaccctcttttaaaaaaaactgacccaaaaatggaacacagacctaaatgtaaaatgcaaaactatgaaactcctagaagataacacaggagagaatctaagggaccttgagtttggcaatgactttttagatacaacaccaaagacacaatccatgaaagaaataagaagtaacctggacctcacctattagaatggccaaaacccagagcactaacaccagcatatgctgaggaggatgtggagcaacaggagctcccattcactgcaggtgggaatgcaaaatggcacaggcacttcagaagacagcctggcggtttcttacaaagctaaacatactcttaccatatgatcaagcaattgcaaccttgttgatttaccaaaaggagttgaaaacttacgtccacactaaaacctgtacatggatgttttagcagctttactgctaactgcgaaaatttagaatcagctaagatgtccttgtgtaggtgaggggctgaacagatacattctgacaatggaatattatttagtgctaaaaagaaatgctttatgaagccatgaaaagacatggaggaagctgggacgtatattgctaagcaaaggaagcaaatctgaaaatcctatatactgtatgattcccaatatgtaacattctggaaagggcaagactatagaaagaataaaagatcagtggttgccaggggtcagcaggcaggaaggaatgagtgggtggagcacagaggattttcagggcagtggaacaactccatatgacgctgtaaagcaaaatcatgtccttacacatttgttaaaacccaatgactgttcaaggccaagagtgagccctaatgtaactatggactttgggtgactggccaagagtgagccctaatgtaactatggactctgggtgactagccaagagtgagccctaatgtaactatggacttcaggtgactggccaacagggagccctaatgtaactatggacttcgggtgactggccaagagtaagccctaatgtaactatggactttgggtgactatgacccaaatgtcaatgtagcttcattaacagttaataaacatttcactgtggtgtgggatggtgactgtagtgggggtggcggtgtgtgtgcatgggtatgggctggggtatatgggaactcactgtactttctgtaattttgctgtgaacttaaaactgccctaaaaattgtctatttttaaaaaacaataattataaactggaaaaattctcttaggaaatcctaaaatatggaagataaaatatgaaatgttttctcagtattaaatgtttataacaaccactttctaaccctcagagagcaacacagcaaatacttattaacagtgccataaagaaataaaagctagtcaaccaaaacttcccattaaataggaactgtaaactttatatacagataaaacaaccacattttcacaaactgaaacttgaaaaattaagtaaattggtcattcactaaattggctgcttggcaaactaattttcaaagaattagcatgttcttggttggaaaagaaaaagaataagcaaagtcagaaagtaacaaaaaagatctctaaagctgggtgttgcccaaaagcagccgatggagccaaccagaggctggaacattacagacccgctttccccaccacccaagctggtgtatgccatgctcccacagcagaagctaaaaaagtacacttactatttctattaacgaatagactatctccttctaaactgtataacattatatgaaattggaagctaaaatgtttgtagtaattgtttctactatgttcttcttctgccttcattgttaagttttatgtttcattaatacctttttagagtcaaaaaattttcaaaatttcaattaaaaaaatttctaaataccacttagtacatgcgagccgcattatttcacagattctttgctaattttcctcccctctgaaatttatttatgaacccacaatcagtgtctgtggcacttcggtggccatttgtggacgtacgtggactggaaaagattcagtcacccacatgaacgttcctagccgggaggaacaaggccatgccttgccttcctgttccagctgaaatggtgaataagcatcctttttgtgatctatttagtgctattgctttcaaatttgtgtgctttatgttggtgattttgctgtttaaaatgtccacagccctaagtgcaagaaggcagtgatgtgccttatggagaaaatatgtgtctcagggaagcttcatgcaggcgtgagttacagtgctgtggatcatgagttcaatgtcagtgaattaacaatatacattgaataaggtacctttaaacagaaacacacataaaacaaggttatatatgattggctgatgaaaatgtagtgaacagaggcgctcaggaacctaaccccgtgtttacccagagactacagtacagcattcactaactcagtgtctgtgcaactttatagagcataactacctgtatgacaagaattgcctgaatatcatagttgaggatttagtctttccttcagattaatgatttattctttcctgagtcttactgccttagatatacagaatcataaaattttaactttacttctagctttgctataaacagcaatcttaagtatctttatttttctgggtcttctcatctgtaaaattagactacatgaactttaagatatatacacttctaatttatttacataaacatgaattatatttaaaatctgtggccaaaaatgtgacatgaatctaaaatattttaaatttaaaagatggatttaatgacgacttgtgtctgttaagtgataaataaggtgagtttagccacaagagtgtaacgggacctagtagcgccccctgcaggccttgcttgctccacagccacatgacttgctcttccctttggcagctgtatctttctgcttaaggggtcgggggcgagggaggcataggtgagaaagtgcgagaacacgtcaatatagggcaaacaactggcacagaaaaatgagcatgtggatgctctaaatcaggggctggtgatcaatatcattgctacatgatggagtagccagggagctcagttttagtgccagtgtggttggggcagaaagaccaaatgagaaaaacgactgagaattcagtgaagcttgtcatggggcatgtgtctgagcctttcaacccagacagggcccaggggaggatggaggacacagctggggaagctgagaggtgcctgacctagatgacgcactggggacaccaaccctgcagacacagggtgacaccactcctatgcaggacagtaagggcacatagctgccctggctatacaacctccatgaagaaaaaaaattgcttagaatttatacttattttatacctagcaaggttctaaaaacatttaggtgtgtatcaatctaagaaaaaactatcctttacataccatgtctaaatgtgcctgttagtaaaagaatttctctttgggggctctgaacaatggaagatgggcaagaggacatagatgtctttccctccttatataaactgatattcaaagtgtatttgagtaggacatttacatacacctgctctctttccaaataaagaaaaaaatacttccctgcactttgaaaaatctcattttacagccagatttccaaacaaaatatactaacaagaaaataaaaagagggatatagaggttgttttccccctaatattgtccaatttaccaaaacttttacacctagggtaaaatgcaaagacatcaatcaaaggaatcactggggatatgaaataaatttttaaatttaaatgaataactatcacatagtttaaaaattaaatatttgttgggatgaaaagagatgaattcaagaaaaaaaaaagtttatttggcattaaaagcaaagttactggcgctgctccttaccaatgaacttctgacacctgaagcattcttccagccactctggcgtcactatgtgcttcacgacagaaatcgccgtcaggaacttcacggtgcgagtcactttgctggcaatgaggtgtgtgcacttctgtgcagactccgcaacctctccaccaagaatgtagagcttctaaaggtcacaaacacaggtcggaaatgaaaaagttcagcatccacagagccacactgacacagagtaacacagaggaatatctacctaaagacaaggtttatgactgtaattctcagccacagaaaacagtgtgacaggtaaaacaaaacctgtaactacaagagaaaaataaaaaagagaatttatcatttacatttctgtagttcaattccacacaaatcaagattaaaacatgaattctccatcaaacatcaataacatatctccatgaataaattaaatgacatgagaatgatgcagctcacttcacaatgaagagtaaacagccaagacttcctaggccaaaactggtgttaatgaagaacatttacctgctatcttcattttttgaaatgatagcataaaaactggctaagacttgagcatataaaaaagcgagctcctaataactatcctcacattttaaaggtggagaaattaatttgttctaaatgtataatactagcatttataattgtttcttttccttaaaaaggaaaccaggagtaaaatgtacgaatccaccataatacaggtcaacttatactcttaaccatcctctccctcaccaaaacaaaacaaaatcccatcatcctttgggatgttatttcaaaaagtatatttaaaacctgtgcccatttatcatctaaacaaatacacaaactcctttttggcctcactctacccaagaaaactaatcttggatagactgtgtttcaatcagagatcttgaaaagacagttttccttcatgctggatgtctttatgaatacgacacagaaggagacttgcaaatgttcatgtgactattaacatggttcctggcctatactaataagaaagcaagtatctaagtatgaaataatagcacagaacagggcaggaagccactaaatatttagttattactataaatactactaaaaatacttcataaatatgcaccataaagactgttataactatctaaactatgtaagttaataaaactgctgatctgaagtaaatatatacaaaaaaggacactgctaaaaatccttgtacgaagtagatgaaatttcaccttaatatactgttgaacctggacaggctcgaatccagtgaaaagcacaaaaggggtcaattctggagttagctttttagtgggaggtggtacgtcttcaattctgtggaagaaatacacataaaatagtagtgatttcatatttacttacaatgaaaattttctttagaaaacaagggatttcattagtttaacaagctttaactgcatgtggtttttattcttaaaggaaaaatacaatgagctatctgtccttcctttctttccaccatttccataaagtcaccttccaaaaaagactacctttgaagcctccaagggaggcatccaattcacttttggttaagatcaatactttcttcttcatcaatcccctcctgattaatttttttaattggctttcagaagaaagcaaatatcaaagttgcttctaaacatcactgattttgctagctctatcacttcatttttttctatcaagtttttaagataaccttgtgtgactcaggccattccttgtttgcacgttcaccatcaatacaagtcagccaagacgagtgtcgctagagcttccagtgtctttcacattctagccctcttcaaccacaaattataaaaacgtggctctgctcaagcacacgttttaaattaaacctttttgttttttacatgaattttttaggtctttttttcaggttattattttctgagacagtccaataaaaatttattttaaaatgtatttgtggtaatttgatgacagcctcaaaaaaatcacataattaggattttattacaaaagtcaacagttcagtttgtgttctggaagtggggaatggaaggagggaaagaggaggagcagggagagaaaagatgaggaacctggtaactgcaaaaaacaattcaagcagttatatttcaccatgtacagtctggaaagaagagttttctagaatcaaggaagaaaataaaagctctgttagtttgctcctgcatttgctatgcctttctaattaaatgattggaaggacttcattattgactcctgctggccgacatgacactaaaatgatatgcatctcaatctgcatactccaagccaaaacccaacatgccatatgcattgcacatgtccttccaaaggctttgggtctggatcctccttcccaccgtggccaacattgctttgtcctcatcaagaactggcagatccaaggagcatacccaagatgacgccacagcctacatgctctctcggcacctacatgctctctcggcacctacatgctctctcggcagcctacatgctctctcggcagcctacacgctctcttggcatgtacagcaggttcttcagccgtgcccaggaggcctggggctccgtggtctatctctgagctgggttctagacctcccaccccacttccaccactgcaacttctgttttacatgttggaaaggggcttcttataatatgccacttaaagaaaaagactgaatttttttaaaataaaaaatatactggcctatgtcattaaaatgaaatatatcccaataaagttgtaaagcaaaaagcaaactctttcaaatcttatttactgcaaaacattttagaaactttcctcaattgccaccgattttccaaagcagacctgtgaaagccagcaatgaaaaatttaaggttattactcatacctggctcttttggaagaaggctggacattagctacttcattctgtttcagtttgggaggtagtcttatactctgcaattaaaatattgtcgactttaattcaatcaatctactaagtaatacagtagcttccagaagatttatgtgtcaaataatcaaactacttaaacatatacaagaatcatgttcttcttcaccacatcagaactagtcttcacctcaaaagatcactaggacaatgcaagtggggagaagcagctaatattccggagagaacctctgtatcgtttttttgttcttttctttccctctttattcacaaaatcctttcagtactttaaattatctttgttgctttttttcctccatgttatatatatgcagccctcaaccttgaacttctcaaaatggtttttatttcaaatattttgtcctgtgtcccaatttagaatgtggaaaacatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcaggcgcctgtagtcccagctactcgggaggctgaggcaggagaatggcgtgaacccgggaagcggagcttgcagtgagccgagattgcgccactgcagtccgcagtctggcctgggcgacagagcgagactccgtctcaaaaaaaaaaaaaaaaaaaagaatgtggaaaacatgattgaaattacacctccaccctaaaagactattcctaaaagagaaatttcacctatgagatttcacaaaagatgttacatgacaatcagatcaacactgctaccaacagccagacaaggtaccaaaacctacactctgcctcagcaacatggtcacatccactaggaccagctccagtccctgaccctggagcagaagccatgccaagcacaaagagagcaggaaggagatgggattcccttgtggggtccctaccacagtcagcatctccattctaccctattccttgttgactcctccttcatagtttcaactcagaggttctttgacttgtgtgggccaaccatgtctttcccaggtgttttattacttgaaggaattgctctcaatcttattaatttacttcaactacaacttattttttctaaatattgctgccatatctagacaaccaaaataaatatatctacagaaagcattcaaaatctattagccctgtcatacatagagaatcaagctttataataatttgcaggaaagtttattactttcctattatagcctttataagaaagcaatttctcaactctatttccaaagatcgcatttaagtctccaaattgtcattcattggtaccaagaatagaaacaaatggtgggataggcaaaaaggataaactgggcctctttgtctctaagatttttagcttttaattactgatacaaagccacaagagaagctgacatttggggcccctgacaactttagaatataggccatgtagtttgggaggaaaactctgatgaccactttcccagtgtgagcttaaaagccaccataaaattcctttcagctaaaagaactgtgagaatatttgcttttgctgatgtgtcaaaactggtcatgtctttaaaattaaaatcataactactagtttaagctaggaaaacaatacatctatgatcacattatcactagcaagaagaaaacaagactgtggcttggaggggcttcctcagagacgtgggatgattatcagcagcttccagatgagatctggaaaacgagtaagtcagtagatgaataaccagaaacacaagcttgggtgttagctgctaatcctcatgaaactattctcctcagctagttgttcaagtggcacaatccctaaattacctctgtatacaatagaaatgtggtgaaaacttggtgggcacatgacatggaaatctgtttttcaaaacaaaggttagtatgtaacaacaagaacataaaccaaagcctttaaattacactactactggccaacagtaaaaaaaactgctgttctcaaagtgctgatgttcagtcgaacagtgagaagtcacagcagacaaagtctaaactgaaaaattattgaagtggtcctgtctgtaacttagtaaacgtgaatgtggggaaaagagaaaaaacaactgatcttccactcatcatgcttgacagatgagaatgcagaaagcacctctttgtcttgtaactaacaaccaatggccctcacacttcaagaatggcctatcctgaaaagcagagacctccagccctgtgatgtgactcccaactcaggacactatgaaaacattcccctcatcaagagacccgggactccttaagttctgatctgtagccccaagtaggttacacacccattgcttccagtggttcttaaagttcttgcctttctaaccctatgaaaaatcagtcctaggatttactggagtagataattcgttatcatgttgacaagttactaaaataatttttaatttatgaagacaaatacatccctactgcatcttaataatacagtaatagccaaggtaaggttattaatttgacataccatcaacaactctgcagacacttttaagggaactctccaagcatctaaagagagaaacacattattttttatgatagatacgttgtttaaataaaaaggcctttttataaaagtcttccctgataatcctcaccagacaggtggtttagctgacaacacttaataaggataaatgtaagtactataatgaagttttaaagaaagctttccaggcaaggtgagggcatgctgctgctttcgtttcacatgctgtctggatgaagtagcactaagaccatcggcagcaaacaacaaagcaaacgttgtgtcgaaacccatggcattcaccctcccaccgtgggttgtctgggtacacatttctaggcctgtgtccaagtctgggtttcacatagtctggcttctagcaggcacaaaccttcttgccttatcacaggagccatgatggcatccaagatgtaacagcaagtcagtcaaagctcaatagtgacaaagaggacagacgtcaattctaggaaagcagggaatgttctgtagggtagggagcaatttggacaaaagattaactggcctgagaggcaagactatcaaaaagctttcaagcgctccttccatctctaagagttcatcaaaagcaaacaaaaatactaaaccatggcacatgcctgtagtcccagctacttgggagggtgaggtagggaaatcacccgagcccaggagatcgagctgcagtgagtcatgatcacaccactgcattccaacctgggtgacaaagcgagaccctgtctcaaaacaaaaacaaaaacaaaaacaaaaaccaaccaacaaaaatcctgggcagagtggggagaaagaagaaagagtatagaaaagaaattggaaatgagtcaaaaactaattagaaagctcaagccaggcctggtaattagtatgaataaaaagatggtagaagtaatgctaatgattttatttaagtaagatttgcagcatgtagaatttcacttacctaaaagatttaaaactaaatgctgggtaggggcaaatggatcctgcagactgaatgccgtgtagcgactatactgaatctgcctcagtgcctcaaagtttcccagaagaatgtcgccaagccactgggcgttgacacagggtatcctccactctttggctttttcatactttaaaccagttggtctttttattttttgaggagaaaacatatttattaaatgttagagatgtcaactgtccaaatgtacatttatttccaacaaaaggcaataaaaaatttctcataatagaagtgggaggcatatcctagcaaagttgagggtgaccctgaatggtaatgaaatatacacctcaaggctcacacagaattacaaaaccactaaggagtcttacttctaccctattcctgttttgttcattcaaatttcattagttcatctaatttcattaattcaaatgttttctaggtatttctactaacattactatatcattgtcatactttaacagactttgatttccacaaatttctaccacaaaactatgacatactaaaaaaggcacaattattgaaatagccactatattgtgtgtaaatttatgattaaaaacagtttcgaaaatttgcttactctttacagatgaggactgtgttgctgcggcatagataacccgtatatttggcacctgccaaataagccattaattttaggtcatctctgtcactatcaacaaatccagtcacagaaataatctaagaaaaaaagagaaaataaggtaaacacaaaataagcaaaaaaccaaaaccaagtactatttcttctacttcttagttgatacatattttttcactatttctttggcattatggaacacatttggtaatatcattcctaaaactttcaagaccagaactgtattaatggtcaaaaggttacacacatagccctcacggggaggaagaaaaagaatgaacatgagatgccttgtttatgttactgcaacactgctcagacaatcccaacagttatgttataaagcacgtaaccacgagccagctcctccttctcctcactgatcccaacgctgagatcatttgagtgggaagacccacaactattgattagttaacccaacaggggccgcctttggtgcaagacatctgatttatttttggattttaaatagtgtcaaagactggagaatccattaaatatctactatgtgcagaaaattgtgactgttacacagaactaaaagaaaacacactatttcttatgagcaggcacttatgaactgggcaaaagtacatagagaagctctgactcagaagccaacgcaggagcctcaggtaagcactagcaagtgattattcgccaaagtcgaaggatgatttaacaaatggaacgcgaggactctgtcttacatgctgtgaacatggctttcctcctggtgggaaggccactgggaagtgaagggctcggtgcggcggtaccattttcttcttctttaagactgtgtttaaccagtgtgcagtaacacatctctttctttctcttattgcctgtcaaacataaaattataggtttgttgtttttgtttttctgctgcaggattaaagaaaattctaaggttgtataactacaatgcccttttcattggaagccccataaaagaatttcatgacatctagcacttgattaaagtaacgaattaaaaccgtgtagctggttacttgaaatacaacctaaaaatgttactatccatctgcaaacaagagtctacaaaagcaacaaattctacaacaaccttaaaaataacttcagtgatgactgaaacaacatgtgtgaccaccaaagttaaaagtgccccataaggacagagggccccacataagaaaaaatacaaaaaaccatccacctaagatgaaccacaggaaaacaaaaaaaagtctcagaagtatttccacatttttacaggaaaagcagatcctgtgaatggctatcctctttaagaggggtgtcttggaagtcatttgtcacatatatatataatctgtctacaataagcattattttttgaaaagaaatgaaacttcagagagcacaggaaggtaatattgaggagaaagcctgcaccccggtagttttagaaaagctctgtaagggacctggtctttacacgcttgtgtgcaagtcacacaccagtacagaatcctgcgtcccttcaccgtgcacagagagcagctggaatggtgactgcagggagtgtccgccctttctttcttttatttttttttgagatggagtctcgctgtgtcactcaggctggagtgcagtggtggaatcttggctcactgcaacctctacctcctgggttcaagcaattctcctgcctcagcctcctgagtagctgggattagagctgcgcaccaccacacctggctaatttttgtatttttagtagagacaggatttcaccaggttggtcaggctggtctcaaacgcctgacctcgtgacccgtccacctcggcctcctgtccgccctttcttaacaccacctgggaacatccctttctttctccattgctcaaagacaatggtgcccacaaaagatatcaatcccaccaaagattcgatcacaggaagaaggaattttcctatctttagaggtagaaaaaagttctttccaaaaataataatcactagcatttaagattgcatattaaaaatgccagaccttgctcctggtcgcagctaaggctattttccttacctgtgcatacgcgctgctgacttgactctcacagagaaggtgcgtgcatcgactcgtgaaggtggggtcaacagtgccgccatgtgcctggattatctacacacaaagacccgaccaatgcagtcatcaatcactcagaatagaggagaattccaatttcaaataaggcagctattaaaagactctatcatatatttatatcatgtatttcctcaaagtatcaaggacatgtaacagttctatttacggacttttctacccagcaccatacaatgaaaatgaactccaatactctaaatttaatctgaattcccaggatacaagagaagaacaatggaatgcactccagggcttctcaagctcaatgtaactgccactctggaccagggagttctgggaagtgggggctgtcctgtacagaggaggatgtttggcagtgtccccaacttctacccaccctatgccagcagcagccccctagccgcgactactaaagatcttcagatactgccaaaggtctatggtgggcagatccacctcccttaaaaagggaaataaaaagcaaatcagaatgaaattagtaaatcccaacagtttcttctcaaaacacatctggttttctgggggaaggaattgctctgtgtccgggctgtgacagctgcacgaccctggacattcttcagaactcaaaatattgtacatggaaaaaggagaatctgacggcctattaggtgaaatataaactttaaaaagacctgccccctaagaaaaccgattctttcacttactacttttaagatgtgaatgtttatttttcctatggctaagcataaatatagtttaatgaggcacaggacaaaaccacaggttcctcacccatccctgcttttcactcccctgaagcacatttagcactttaagctgtttccactgacaattattaatatattccaactaacactttatattagttccttttctctagttttacataaccatctacctcctactgtggacaccgttccccccaataacacacacattcttcaagccttcctgatttggttatatccagactcttgtttagatcattcatcagtgacttaacacaatgtagcccagccacatggcttaatatggcagcctaagattagagttcctttctggtataaactttggttttccctggtgctaatcacttcctcatcccagccccccagaattttcccttttcttagttttctatataccttttactatttcattcccaaactctatgaaaaatgtacatatggtggttctataatatgtctgcaaattactgtatactcctccctctaagagttggagctttactcccctagccttaaatatggtctagacttagtcacttaatatggtggaattgacagtgggagtctcccataactcagtcacaaaagacaccataacgctgcgggttttccctctatcttgggtcacaccccctggggaagggagccagctgtcatgctgtgaagacacacaaccagccctctggagagcctctgtggtgaggagctgaggcctccagcccacagccatgtgacggaaccatcctggaaggggctcctgcagcctccgctggcatcctgactgcaacctcaggagatagctgagccacaaccgccctgccaagctgttgcaggatttctgacccacgaccaaactgagaggtaatgtttattgttttaagccactgggttttgagataatctgttacacagcaagagaaaatgaatgtagtatcacctatacttaagcaacacaggtgtgaactgtgtgggtccactgatagctggattttcttccacctctgccacccctgagggagtaagaccagcccctcctgtccctcctcctcctaggcccactcatcgtgaaaacgacgaggatgaagacctttatgatgatatacttccccttaatgaatagtacatatattttctcttccttatgattttcttaataacattttcttttctttagcttactttattgtaagaatatggtaatacatatacaaaatatgcgttaattgcctgtttatcagtaaggcttctggttaacaccaggctattagtaatttgggttttcgggaatcaaaagtgatgtacagatctctgattgcatgggggtgagcacccctaggccccacactgttcaggggtcagcggtacatgtctctcctcaatctaccagtgttttcgtttgcttgctcctcctggaagtctctcttccggtcccaggtctagttctctcgacacctactttctcatctattggcgtttccctttacctccatcctaggaactctctttcaatctctgagtcaaatgcctcatttcctggctaccatgtttcactctctgctggcatagtggcttcctaagaaagaatataagggaggtacattttttaccattagtctacaaatatcctccttccatagtcttatgactgataggctctataggttattttaggttggaaattattttccctcaaaaatggaagaagctgctccattgctggcccccgcgcactgcactggaggctcccgaaatcacccagactcctgatctgtccacgtttcccctccagtgagcttgtctttgagagaaaacagttttctctaccagcattgtgaatgttcccagttgccttatcatggctctccttacatttcttttcaacctgagggcacatggccttcagttgcaaagctattttctttcataatgttcttgccttcattttctctgttcccaagatcctatttaatgttagacctcttggataaatcttttaacttgaaaacaagacaaaaaccccaaacttttctccactaacttttgtatctttgagttttgttgtacttctcaagacagtttctcagtgctgccttcgaacacttctgacttttaaaaaatctctgctgctgtccttctcagaactgctcccttccttcctcaccctggcacatgccatccgcctctttcctcagccagccacacagtcatctccctggtcaccctcagattcaaccctttactatttaaaatgcacagctgatcacttcacctgcatctaaacttcaccacatggcacaccaacaaggtcttggaagacacaccagccctggctcctgccccaacccctgcctcgtggatcccactgaggcaccctcctttgcaccctcctgtcagtttcaccaatcacatgcctttggctgtgctgcactatttggaaaatcctcccccctaattctcactcctactcatcctataagcagttcaggaatcacctctcccagcagacttttcttaacacatcaccccacaacacgatgggtgaaggtcctttctcaggctctcacaacagcctgcatttgccaccccacctctgcttagccgtgtggctgcctctcgcactgctcttccgttttctccgtctctgtgatttcgcacatattccctaagtcttgcagcatgcttggcacatagcagggatttaagcactagggatgtttatagtgaagcacattcaagatatattagaggcatatttaaactcggtttttataaaaaaaattttttgactcagttttgttttggggaatgcaagaaaaagtatttcttttctttaaaggccaccatgcatgataatacataattaaattaactccagtttcacaattgggctggaagaatttgaggttctagagattccaggattttctaacagttacctttggagaaagagaaatgactgagatgcatacaaattaatagtccctctcccaggacaccaaaaccctgaacttatttccattgccccaattatacacatataattagtgccccctggaatttccaagctgaaaaaaataaaaagtccaccatcttcatctaacagctgagaaaactgatgcccagaaaagtgctgtgcctcaggtcacacagaatgttaatcaaaatgcccgtcacacattcagaacacgtgcaggtgcagctcagtgaatgcagctaagtgaacacagttacatctacataagaaagaagcatcttcagacacagtcatccttcctccaggcacaatctcacccttttccaggtggccagcagttgcttatcagacatctgctctggataatccgcaattgcaaacacacatcccaataagaagccttcttctggaactagagtaaaattacataagaaaaagaaaattaaaaccctatgaatatgcttgcacaaaagttaaaaagtggcgcctcacaatgtcaatctgttatgtttatcagtcttgaccatgacgtatctgccagtaatcagagtgcatagggaatattgctacgaagatactatttaactgtctacatcaaatgatcattaaaaactaaaaccaaggtaactcatgcctggccattaaataccctgaatgagtccctgtggcagcctagatgttctacgggacaccaatattcacttcaggatatgatgtcccaaagtacaaaagaaagcataattatcccatggtaactatattctttgttaggtatgagactcacactctccattttgtagtaattgttttgatatgaatcctcaccccacactcaaacactctcaaagcatttatgtgggtacaagacttttaggagagaggaaaaataatctccattactaactctccactgctggatcatgtccaaaaagctgatgctgctgaggcgatggtggtggctgctgttgctgctgctgctgcgggggctgctgaggtggaacctgatgctgcagcgcctgtgacgtctgactcaagtgtggcgctgtctgactttgcatctgctgctgctgctgctgctggtgcatgcgctggagctgctgctgctgaatctgctgttgctgctgctgctggagcaggctgtgctgctgctggagctgggcaagctgctgctgctggagctggtgctgctgcagctgatggaactgctgctgcagggcatgctgctgctgaaagggctggagctgctgctgagggcgatgcagctgctgtggaggatgcaactgttgctgtggaaactgtagctgttgctgtgaaaactgatgcggatgggcttgctgctgctgctgctgttgctgtgaaaatggatgcggcggctgctgggggtaaggttgctgagagatctgctgctgctgctgctgctggagctgcattatctgctggggctgaaggtgtaaaaccgggtgctgctgctgctgctgctgggcctgctgctgctgctgtagcatgtgtgtctctggagtcactttcacttggctaaacagcactgcattggcatttgtatgtccctgctggctgtgattcacctgctgttctaaatttttcgtaggtgctgaaagagtctgtaagatctacaaaacaaaagttaggtgaaacattatcaacagttcctgaaacagatgaatgataatttcttagtcaagagaatggcatatcctatttattaacaatattcaactaagtagacacagcaaatgattggaaactgcaaaaacaatactgcattttcttttgtatttattttgtaacgccaatatcgtaaagtaaattcatatattgagaccaccaaaatttgaaactacatcagtaaaatggagtaaactaacgaattaaagtgacaaagactcagacggctgatgtgtttgccagagcagggcatgggagtcctgtgcacacctggtagctaagccttggtgctccctgcaccgtgctgcggcaccactccactgcccatcgcctgcatcagctccgcagaccctctcctggcccaggaatgcactgaggaatgacaggtggtgaaggcatctggtaatcgggctcagcctcacctcaaaccttctcgccacagctgccacttcccatttcctcttgtcttacagcccagagtctagtaaacaaaggttctcagtggatcaccttccagatgaaagcagcatgacccaagctgtgagtccaagagcctttcgctccactgtcaacttgctatgtgcactggcatgctatggaaaaggaggccagctaagacaccaccggggctgtttaaatggtgatgttcctcccaactaaggactcatcattagagctgggaaatgatgcttcctcaaaaatgactgagtcttcatgggggacacaaaaatatttcaagctagaaaaaaagaattcaaaccagactatttgtcttctagctctttctgcttcacaatgacagggaataagctgagagttctgtgtacgctgaggagtaggagaaggacggtgaccagcagatgcccaccaagcagagtaagttatttttttaatatcctatagggcactgaatacaacaagagatacacattatacaatgaattttgttcaacatgctcaagcaacaaaaatttgaaaccaacttcttatggtcatggaaatcagtaaaaatagattttacttaactcaatccatacaacttttaaccctattaaaagcatttaaaatttaaataaaattctaggaatttaacacatatcagaactataccaaaatctcaaacatattctaacatgtatctttcacttaaacagattccaaattgcaaagattatatgacctgcaagggtaacagattttggatttagtaataaataagggagtttagaattgaaataagtcaaaatcaagagcttgggcacacccatctctaaaatcaccttatgtatgagacatctctataaaaggattcaagacttcagaaacacctgagtggaactctaagcagaaaaatgtcttttaaacaaaataataagacaactgtttcatctccatatttaaaagtatttttaaaaatccagaaaagaagatgggacaattcaccccacaacatgccaccccatggagcccagcagcatttggtgctgtgcaaacaccccctaagaagcatgcacgtgtggggcacctgcctgcctggtgggcaccagccatgagccctacacggcaaactgctggaaacagcggctgcctcttgagaaggtaaacagcagcgaggggtgggaggggggctgagagtttaactgttcactctgtcctttggtatcatttgaatttttgaattttgtacacatattactttttcaccctcatatgtaaacagcccatggaactctgagggatggtaaagaaataaatgcccgtctgcaggtggacagggctgaactagtcattaccaaatgctgctccccgcctctctgtacctgccaagcccaggtggaagggagctcaggaacaggcacaggacctagacaaacacagcagcagacatcaggacagcacagaggccagaggctcctatttttcagattggccaagaggactcagcagggtctgctgcctgcagaaagtgctccatctgatctcagagggctgagggaggcctaggtaggacaggaggcaacttacagctgtttctactacgggcttgagttaagatgggtcctcatccactgctgacccagcccatccactgctgacaggaggcaacttaacagctgtttctactacgggcttgagttaagatgggtcttcatccactgctgacccaccccattaagggagaagaacagatggagattcaggacaagagtcccggctaggaatgaagatggccgttggcctggaaccttctccacttgaggaagcgagaggtgcaggcctggatggagaggagaaatctgcaaggccagccatcgagatgcctcccaaaacccctaccacattcatccgatcactttttcaaccatctgatctgcctctggctggaaacatgttagtcctggagaacgtaagaaaaagaatcttaattgctcaattacgtaattgtgctatactacaaacaattctgaatgaatgtcaagtttaaatttttccatcacaactgtcataatcctcatttacattaatactgagttactgaatgccatatatagaaagcagtatgatacacatcacatggcttctaaccactataaatttgcaatttaaacaggattttgatggtaagttacactccccccaacaatctaatgttcaactaaatctgtctcatatttctaaagtttcagtcattttcttcacatctagaagtaaaacgtccttatgttctcttgcattgctgaaagtctctcagaaaatctccgcaattcttctcactagtgatcaaatccattcactcactagaaatggatggagccttctcagttttccaccgctagagcacacagctgagtatatcaaatttgtctcctaaggacaatttccagtgcagagatgtgcccaaactccctactgcagtcaattctttccatttcaaagtaaattattttgtctctatatccaaatacaaacttaaggaactttatatttaaaccaacatccattgtatttgaaaaacataataaggccaggcacggtggctcacacctataatcccagcactttgggaggccgaggtaggcagatcacctgaagtcaggagttcgagaccagcctggccaacatggcaaaaacccgtctctaataaaaatgaacaaacattagccgggcgtggtaatgggcacctgtaatcccagctactcaggaggctgaggcaagagaatcgcctaaaccagggaggtgcagtttgcagtgagcagaaatcccaccactgcactccagcctgggcaacagagtgagactctgtctcaaaaaacaaccaaaacatatatattagaaataagtagtaactaaccagcagtaactgaccaacactttttgacaccacagataaatgaaaagcaaagaaaatttcctatttcaaatggatgacttctgtccataatttctcacctaaagaaagtgagaaagtagccatttctcgaagtgccagaggcttaatccatgatttctcacaccaaccctatgagagagatctttacggcccatatctcgcatatcccactgctgacaggacaggtccactgcgtggccgcagtcttcctgccaggactgggtcaccttctcaattcctccacctcagcagtatcatcactcttctcatgactgaggtcaaaaatgctagaatcctctttgcctctagcctgtcattctttatggcctttactttctacctgtcatgacatcctctggctctcaggacgactgtgtgatcgtcactttgctgctctgtggctgaggctgtgccctgtggctttatcccgcccacctgcctggacgcggatgtgcagggaccagggccggcaccctcagcattgggcggtgctggagctggctccttctgtgcatctaccttttccctaaactcggctgaccccagcgctctcatgggcacccacctggacaatccctggccttgcagctcttggacctcctcatcttggtggccttctccccatttcctcagccacacattcccaaccacccccaagacccatggtcagtggcaggcctgttttcctccgggacccaacaaggtgacatggagcggtgggcactgaagcaggcccaagagctcctaacgggcagctgctgttcagttacaaggcactgtcaccacccaggacttgaggaaggccagctcggcattttatcaggcatccacctctcaagccagaaacccaaagtcttccctatctatgaatcacctatttgaaaatcttctattctcctcaaacccgatgaccttctctctctgctcaccttctcccccaccatcttaactgtctgctgtctaacatctaaagggcatgtttgcctctatcttactctggatgccagccaaccgctgtcatcatcccaagaaccgtgtactactaatactcgctgcttaggtggaggggaggggagacaaagattttgtctgtcccacagcatttctaaacactacgtaaaccactgctattatcatacccaataaaatgatcattgtcaacatcaccttatacctacgccatactgaatttccccacttcatcaacatcaagcctttccactgaaagtggatgtggagaatactggatccggcttcaggttgttcctatatgctacagagccatttttctgggactttgagctgtcattatgaaatgaaagtgtccagaacaaggtgaagcggcagacggggtgtcaccatcagatggaacagcccagctggctctcaatggtgcggctcctcagagcctggccccagaccctcctcttgctctgccccacctactacacattctcacatccgcctccacagcttcagtcagccttgttttctctggttccaccacgtagcagacagcccctgcatggatcagatacctccaacccaacacatctgaaaagaaacttaggttcttcaaacctgcagctttccagtgttccttatctctgaaacagcatcatcttccttcactcgctcaagccagaaagctggatcctcccattcatttttttctgtctcaaactccaactctatgtcctcttaaggggcctctctgcttcactcttgcccctcaaagatccactgtttacacagagtgcatctcaccccaactcaaaagcccagtggcttccttccaagaaagaccatactcctcactatggccctatatggcaaggccccttttaaatccttcctagaactcattcaccttatgaagttcaaatttcattaactttcttttcttagaactcagcaaattcatgccatttgggtcttccttttgcctgggaactctgtgccctcagttcttcacatggcctctccttgtcattcaaccctgatctaagtcacctcctgcccgaggtccttcttgaccatctcgtctaaaatagcctccttcccttcacctgctattacgggaccctgattattttctttgaaacacctttcaccatcaacagtccttttgttcatatttctccacttactgtatgtcttctctacctaaattagttttcttagtcacaattttatctccagtgcccagaaaaatgcagagtggccaatataccacctcaactaccttctttctgtcttaaatagaaatatatgtacttaaaacttttaaggccatgcgtggtggctcacacctgtaatcccagcattctgggaggccgaggtgggtggatcactagagatcaagagttcaaaaccaggctggccaacatggtgaaactctgtctctactaaaaatacaaaaaaaaaaaaaaaaattagccaggcatggtggcacatgcctgtgattccagctactcgggaggctgaggcaggagaatcatttgaacccgggaggtggaggttgcagtgcgcagagatcatgcaactgcactccagcctgggcgacagagtgagactccatctcaaaaaaaaaaaaaaaaacaaaaacaaaacaaaaaacaaccagcaacaaaacttaagatccactctgtatcaataagctccatgctatataaactgtaacctgaaatcaagccttcctcaacaaatgcatgaatttgtgttatttatttactaccatgaagttcattataagcaaatcaggtacagctggtaaacttcattattctctttgctgccattgctaattttaaactaagtaagagtggaaacccttcaacggatagtactccatcactgacatcctggttctactcagctgctttaaatcttcaacttaaaatacgctgttaccctttttcaatgaccctgaaatatacatatatacacatacacacacacacacacacacacacacacacacaagtaaacaggttctcacacaaatactgcttgtaagttatttggtctgaaaaagcaaaaccaataaactacattgaaatagactgtgaaatccaattctaagatccaatactgacatttttttcggaaagagtgacttacatgtgctacatttgatggccggttcatctgctgaatgtcagcattattagtaatattcctcagtgtccgtacagctggactccaggtagctatcatttctgatctttcagaactttggaggttttgtccagcagccattaaattaccccggacctcagggggcaaaatgttacctgggacgggtgggacattggcacacaagttaatcaacccaggctcctttccctgaggcagcctgcgttttgctgcagctaactgtgggacttcggccggggtccagtttaaatttctctcctgtttttccggtgatgaatctgaagaatcatcaaacattaattcccctttagatttttcagtgttggatttaggtgaaaactgctggtcacctgaaggagacccttcttgagagctggcagggcttgacttctcatctgtactaccctcattctgagaatcttgttcctcattttctacttcctcctcctcttcctcttcctcttcttcctcttcataaataatcagacgaggatgataaaatgcttcgtcctttttggttttctctgatacgcaatccagaacccagtcaggagtcacaattttaatacttgctcgctttaaagcacattcgtatttctcctacgaggaaagcagaaacacacacaaaacaaagctgtaaattttatcacatttcctacaattacgcattttagaaaaaactcagtcaaggaatgcagttgaaatgttgagcaactattattacaattttatacagaagcaacgtttgatcttttagacagaggacatgaggcaaaagtgaaaaggaaccatacagcagtgatcataggaaggtctcacacctgtagcaggagtcttaaaagacttggctgaaaattaactttttaaaatgatattttaagtacaaaagtagagctagtaatcctatggaaaattatgaaatgaataattgctacctaagtttttactgattgataatatttagaagcttggttttccatgacagttagtaaagtaacagcgtggcagagtgccgccaatgcatcacgtacactcatggagcatggctgacttggctgacttgcataggacagctctattcaagatccagtatttatggagctcatgctatatgccaagcagcactaagggatggagacacaaaggatgcaacaagtctctgacctaacaaggctcacaatttggttctaaagagatattaaatacggaatgcaaatacaatataaaaccactgctgaatgatgcagtaacagactggaagggaatctcatcaacataagctggagggcaggaggaaagccccgttgaaaggtgagctttggctggggcacaaatgatgacaatttgcacagttagaatgaaagcagaaaatacagcccactggaaaagatgtgtccggagtagtatgttcggcaagctaacagagacctctcctgtggtaaagggtgtagaatgtggaaggcacaggggagggaataacaaagaaagaggaaataaataaaaaatgttaaataagagtaatatgacaataaagtaaccttaaaataaatgagttgtaaatttggctgtgctcctaaaagcttaacacataacagcaattctctagcaaacacataatcagggccctaaactaaactccgtgtcctgttgcagagccccaaggtggcatttgcaatttctgggtggaataagagtcacacgcaatagggatgcggggcagcagcacagagaggacagctgttggtcattcggtcctggcagcgaacgccaggcattgcccatctgggagatccttgcaaatagtgagctctgcacacagctcagtgacttaacttgtgtttgtgagtttgttctttctcaaacctttttaaaatataagaaaaacctagtcatgggagacacccatgaataagaagctaagcaaaggaaaatgaatgtaatcataatcacactgactagaaaggaccacgattaacatttttagggtatagtttaaatttatttttgttataaatatatatgtacatatattaaaagggcaaagggaaaaaacatatagtcatagtgaacaaatactttataatgttcctttttcacttaatatattgtgaacaacctcttcctatgaaaacatgtatacttttatgcttttgtttttaactttttaatgtacattttcgaacacagaccaaactttttaatgtacattttcgaacgcagaccaaactttttaatgtacattttcgaacgcagaccaaattagagactagtggaataaatcccttgtatctgtcacccagctttaataactggcaatcttttacaaatcttgcttctcctgaactttgtttacggatctcaaattgataaagactttctaaaccaccataattatcatagcagcacaatgaactatgattcacctcatcctcaggccctattcagatctccccagtagtctcaaaggcttttacagtttcctcttcggttgcacagctgtgtaccttagttcatcccccagtgttagccacgtggttgtttccagtgtttcactactatgaaaaactgcagttatattttatgacaaattcctaggttttggtgttgaggtttgaaaaggaatagatttaaggcttcatatctctaactacacttcccttcccaaaaaggctattccaattacacttccaacagctatgtaagagtacatcaatttacctataccctcgacaataaaatgtcttattctttaccctaaaaaatcatgctgttcttaaatatttaaaagcataaaatgttatatagctctccccagatgataaatttctactagagattttcaatttctggactacccattccagaaaaacccaagttattttaggaaaatatgaagtccaggtacacagcagaatatttatgaaccaattaatacaaaaatatcatctgcttgaataacatatgactatatgtaatatggtttacatatgatttttccaagttaaaaagatatctgttgaaatagtaaaatatgaaaaaaagttatttttaattgttttaacaaataccaaaaaacaaaacaaaactactgccatgaagaggagtcactgaaaattttggatatgaaaaagataatttcacacttaaaaggctgggatccagtaggctcttgagttcctagtttgtatagaatgctggcatttcacatttcagaaataacttgactatttcctgtggaaatctaagtaaaacacttaggtaaacagccttactatatttcactcaagttttctctcgcttttcacaagataggtagtttttaatcactgaaagacagtaactgtttaaacaaagatgatttaagaggaaagcaatgtttagatgcctttgcctgacccaatttatcagctaaattattctaaattttgtatcctcaaaacttctaactcactaagggctaaggacctcaagggtcaaccatgtcccctctccccaacaactaataaccataccccgtttctgttggttttaagttataaattctttcattcttcttaatttgaaacttttaaacttcaagagtataaaaggtagttttattaggccatttgcacaagcttttgctatgtgctcattaaagaaaacaaaaacatttactttaaaaagaaatgttatttttgtgtacagtcagctggtctctagcactcataaaacttacaaattagaagaaactatttaaattcaccactattaggtttacaaatttatgtctgaatagattataaaatacaataatttaaaggaatgataaaaattaagtctttttaaagggatttaatttttcaaatatttgtggttattgagttacataagccacaaacataacataatcgtgaatcaagaacataattatattatgttaattataatgtaaataataattaatataattaatataaccattttggttttataaatagactatgccagaatatatggttccttcagttcattttatagactggtgcttctcagccttcaaggggtgagttagaaagaaccagggaagaggcgaggtgaggcagggaacaccacgccatagaagggtgcatggcctaccaggatccaacaggaatgaaacactattgccttaaagacaacagacagacatgagcatgaagtccaactgtcaatttctgatcctgtgatcttggctgaaactaacgcagtgacactaaagaagagctgttaccactccccgaaattttggaaatttgtgagagcctattgtatttgtcacaaaagctggctggaaggaaatggttgagggaatgctaagtcctagaatgatcaagacaatgctgcatagtcgaggaattaccctacaaacattctggtaacgtaccatcagtcatattaaaaaatatctggaggtatgtacttaattttccagaaaaataaaaataaaaataaaaggaattatttctagcttattcaaaaatttacaagttagtcagttttttttttaattgaattttattggaaactgtcactaatggcaatgatcacttaccctttatgtcatcattacaacagatatacaacattaatctttttttcgcagccgctatattgatgactgtaatatataaaaatatatgcttatatatgttatacatatacaaatatcttttattttttgaagcagggtctcactttgttgcccaggctggagtgcagtggcacaatcatggctcagtgcagcctcaacctcccaggctcaagcaatccttccgtctcagcttcccaagtagctaggaccacaggcgtgagtcaccacatccagctaattttttattttttgtaaagatggggtctcactttgttgcccaggctggtctcaaacttctgggctcaagagacctcccaccttggcctcccaaagtgctgggatttacaggcgtgagccaccacttctggcccatgtaatatcttactacttcattgtcttctagggtagttatgcttgagcattaaaaaatcctggatgtttttcattattaattgctctctttctctttctttacatgtgggcattatgccttcttaaaaattaagggctgggagtggttctcacgtctgttatcccagcacttagaggttgaggtgggcagatcactggaggtcaggagttcgagaccagcctggccaacatttggtttctactaaaaatacaaaaattagtcaggtgtggtggcacgagcctgtaatcccagctacttgggaggctgaggcaggagaattgtgtgaacccgggagatggaggatgcagtgagctgagatcgcaccagtgcaccccagcctgggcgacagagtgagactctgtctcaagaaaaaaaaaaattacttaggaatggtaatgtgtacagaacggggttagagaaaggagtggtgggtgtctgtgtttcagtttcttcaaggggacagcaggacttccttcactgtacgccgcaagcagcactgtactggcacttagtaagtgctcactaatggctgcgtattagtgttatttttattactggcagatacaaaatctgcttttaacaaatatttaccattgcagaagaaacacagtaagcattaaaatagtagttcatttttccctatgttgaattagttcatgtaaaactgggaaattaaaattggaaaagcaaaaaaagagttatctttcttttccagtccataaatgaaatcaagaatgaagaacaaatacattacataagacaatattataattccaccattgacttagataagataatctctatatacatgcataatacattatatatatcacgtttagtatcaacttttaaaatatatggagtatttgctttatctaaatgtaattatagtagcatatttgttgtcttattcacaagcatgttttagccaaagaaaaatgatttaagtgcctctttgttgggataaataaagctcaattaaagtatttatatatagaccttatgacttagatttgtttttccttccaaataaaaattttaaaagattccatttttagctatacacttaaaaaattagtctaaagtcaataaatactttaaaatatatactctatcctaaagcccaaagaattactaaggatttctcatcaaaatattttggaaggggaaaaaacgctaaattaaggcactagaattaaaacgtcaaatcacaattcaaaaccgctttgacaaacccactctgttcacacagtgcctcttaaattgtcattctaaatcagtgaaaaaagctaaaggtttcatttccccttcaaattaactatgtaaaaatcaaatacatttttgctataaatcaacattaatgtaaaaagaacccactattttaaccaaagcatactgtttattacttaaactgtcatggaaaatatgttttttacttaaattttagaagtcacatgataaattttatataatgctttctatagaacagtggttctgaaactttagtatgcatcagaatcacccaccagaggacttgatcacacactgactgttgggctcatctgattaggtctgggaagaggctggacagactgcatttctttttgtttttttgagacagagtctcactcggtcatccagactggagtgcagtggtgtgatctcagctcactgcaactccacctcctgtgttcaagcgattctcctgcctcagcctcctgagtagctgggattacaagcacatgccaccatgcctggctaatttttgtatttttagtagagacagggtttctccatgttggtcaggctggtctcgaactcctgacctcaactgatccacccacatcggcctcccaaagtgctgggattacaggcatgagccactgcgcctggccaacaggctgcatttctaacaagtccccaaggggggcagatgctgctgatccaggggtcttacttgtggaaacaaaatccatacagccacaccactgctcaaggatgagagccctatgcttatcaagacaaaagtcattttcatatattccagattatgaagaagaaaatatatagaaaatttcaccacacacgtttataattatacctgatacaaggttcttaaaaaaaaatggtgacgggaactaaaaatacatttttttaacaaataaaaatgaaccaaagttttactggatttgaaaggaaattctacagattaataaaattttcctgttttccgcataaaatgaagcaaaatttcatagtatttagaagttatatttggcttacaatttacaatcatctcacatcgtttgtggaatgaagctggatataaataatataaaccaatataatcagcttttgtaaatgaaatataataactaatttaaaagaagctcaaaaaagacatgtgattactagaaattcttaaatgacatacaaaaagaaggtggcacaagaaacgcttaccccctttggctctggaacaatcaaatgcgtgcatttcttattgagggttagctggcaatctcccccatagaacgtaaccaaagcccacagggcacttctgtcttcagatgacacctgacagaaagttagaaagaaggcttttaccatacatttcaatctgtgcatggctatattttcactttagtaatatactgcaacaattctgtttctcccttaataaaattaacctaagaatatttgtagaaaaaatagagaagcttttagctatctgcttattataacaaaaacttcactcctatcataatagttttacatatatgaattacttatttttgccttgtcaccaaatgaatttaaaaatatttatatccacattccaaaaagtgaaatggaggattatttcagtctataacaaaaatagtcaggggaaaaaaagcaggaagaactagtatgccattccagtttccatttgtgtcacttttgaaaatgtttaaatacaacagcaatatcaaaatcgtattttaggaatgcctttatgctaatggataacaaatactaattatgaaatgaataaaataaaaataaagataaaaatatggtggcttgtaagttcaggggaaaatgtaaatattacttaacacaggaaagaaagaaggcaagcataaaaggaataattcttatgcttgctcagtgatgaagtaacgactccagatacaatggcttatgcagtcaaacaggctttcactgtaacaatagaaacagctaccatttattgcctgcctactatgtgccaggaactgtgccaagtgctttatctatacagctaacccttccaaccgccatgtgaaacaggaatcatccaccccattttaaacataaggaaacacactaaattacacctaataattggaaaagctgacttttaaaacccaggtctgtctacacccaggtctaactccaaactggactttccactgttctacagtgcttctctaagggcagttactgctgggaaagtcaaaaataatttctaaaaaaaatgaaattttagagtctgaaaagcaaaagaacatttaagaaaaataaaaatataagcattaattctaagataatcatttaaccgagtaaattttttctggataaatttattgtaagttgaggattatagttgttgaagaatcctgaactttgtctcgttaattttttaaaagtattgataatagcatgttaatctctttttaactgccagtatgcagcttgccaataatctagcattgttcatctactctcatccattttacaaacatttctagaaattattctgtattacacactattctatgaatattaacaagaacatgttagctttctaaaaaacacttttcaaatcattattttataacttgttaatttagtaagtcaatgtcacatttcagaagactggaccaggttatttttattagaggctttcacaaaaacatttatatcctgcagcattggagagttgagatttaattatatgataatacagattaatccaatgagtcattatctaatctttattaaaaatgaaattaaaaaacaatctagatatgcctttattaccaagatttgcctatctgttcagttaagtattattttattttactgactgcagtaaatctagtcctataccctatttggcctgtgtcacaggcgtagacctcaacagggtgcaggagattgctgtggaaagaacatcagctagggaggaatggaggagacctggcattaatacgacgcctccaataactcgcttatgtcaacttggaaaacttccatgacccagattcttcactgatgtacgtttggattaaatgactttgaacatccataccagctcatttaatgaatctccaccagcgtaattaagaatgctctttccacaccaaaatgttaacaatagttacttagtggtgataggattatggggacatttttattttcatttttatacttttctgtattttccaaattttcaaaagcattaattttataattggggaaaagtgcttttcttttttaaaaaccatctttccaaaataccaatgttatcatgttggctaataatgtctcctcagtgctgcaaggctaaaatccaaaggctcccccatagtgtccaggcccttcctgtctggctgctcctaaccacctcctcctgcccatgagcactgcccccacgtgcacctgccgtcctcaccacgttctgctttcctgtgccccgctgcgcccaccctccgacctcctcctctaagactcagctcaggtggcattaccactgtactcccacagcaagctggacagaaatctaaatacttctcacactctacaactatctgcttgcttatctgtcctcccagctatactccaaagcaaccaggagcagaggactagaatttcaagtctgtgcccccaggaataaaagctttcctttaaaccaatcaggaacactctcccttttccttcttcaggcctcaccacccccaataagacactccttgattctagcttacaggattttctccttgtccagtcttgactatgaactctaacactccttcttaaagagtcttacatgatgtcctaaacttctctgagatctttcacagcacctagtacagtgcaaggcacatgggtaggcagtcaagaaatactgttgattgagatacagaatggaaaggactttttagtcttctagattcaaatcatgacctagccaggctctccattacactcttgacctattccccaaaacctacccagcacattacaacagaggcctcagcctgcatcaataccgggtcagaagaaggcagatgatctctgtgcttcccaacttctgctggacaagctcccttccctacctctccctgggagagctctggaagactccaacaaagagctccagcttgtatcaacaccctgacggggaaaagacagaaggtcactgagaaccaccaagaaacagtccttttgtaaagctggggtcctgcctggcgtgtgcatgtgagtgtgtgtgcgcatgggtgctccagtgtgcagaaaaggtgcagatccctctgacagtctccaatcagttaggactaaccactgtgagcactccctcctgcttctgtacctggtgcccactttcatttttgcatatgttgcaacataccgtatttgcccaaggcctgacccctcctagactgtatgtttactgagagagaaatcgcatcttaattaatttgtacccctctgcattgctcctgtcacaaaggaagtacccatcaaggatttgttggaccaaagtcccttagctgcacactgtacatatgttgttaatgtatcttacaaccaaaataacattttttagcaaccacaaaatattagtgctcccaatgcacttttcttaaactacaatttccagggtttcttcatagaagtgactattaaagtcttccccatccctatttgaacaatctttctcaacttaaaagaaatgcttttattttaccccatgacacactggggattccaattcatcacgctaagtgatgaactgcgggaagtacagtaagtgacccacaaagatcatgctatttctggattctgatttttcttatccactgaatttgctaaaaggatataaaatactatcaaagagcttgctaagaaattaaccttttggccatcattgacccagccactccccttggtaagtttagcaccaaggtaaaattggacctttcacctgacagtgggtgagcagagccccttcccagaacacacaatcaaatgacactattccactgcaaagaatcaagatattcaccttctctgagcagtctgctcacctagttgtttctttatggatatccatcctcctatccccacagggactacactggtgacttctcagctgagaatccaagatctacttagaccccttagcctgtgtgatgctcactgagccagctgatactcctgtatcactttctatcatccttttcctcctcttcctgggtcacagaataggactcaggatacacacaaacctatgtacaactatcttctaccaatttatgctctaaatctttacctgggttgttgttatttcccagcaatgaaaataaaaatgattaagtgtgactttaccttggtttctaaaaataacgtcctcctcctccagtatcatctctgttttcaagctccttctttttttcctccccaaatctctctaccaatgcgtgctatccaaggctctactcccagttatctgctcctctctctatcatgctctgcaggaatctccttcatgccacagcagctccaagttcctacacttccataccttatcaacagcccagagtgtgtttcaaaccagtgtcaccatctcccctcgccaatcaggctcctccctatttcccagctccttcagcggtgctgccactttcctgtgctcctcgactgaaacaatgacataatctttggcatccaccatgggatctggcacagggaggtatacagtgagtgctggcttctcactctttgcaccacagcatcccatgtccccaatacctgctgagtcccatctgttgctaagtcccatgttgtatctgctaccctgaatcccatctccatttgtcaaaactccagcctctgtcctgccctgcaagtcatcctcagagctcctggaccagttttacctgcaatgatcacaagtgattctaattttgtttgacttttggtttcccaaattttctgaggtaagtatttgtaatccaaaatcaatgagaaaaaaagggtgatgaagcatcctgctacctactttacccagttcaaactcatataccttggtttcccatcgtctctatccatctacctgcctgaccattttttcttctacgtgcaaatgcacacccttggttgacaccagtctcctcttatctagcctctgtgtactcctgacttctccttccaccttgctctatgcagaatgccctcctcccttcccatttcctccaattctgtccattctttcagggccactcacaccttacatccactctgtcaaggcttccctcgcctcgcaatccagaccaatgccatccttcctaagctcatagaatcatacctgtggcccctgagtggtcatatatgtatcatgtatgtatgtctacactataacctaatttattacatgtataatataacaatttgttacaaatataaactctgttaaacataactattagttctttggaagactaataatattcttttgtgctaaactcatagttaatatttaacaatatctaattacctcatttgaaaccctataatcatcttatactcacatacttttgattttcttatttatttcaccaaatcaagtcttcaaaatcccatgtcactgtgaccttcatctctgaaaaatgcccataggactccctgtccctgtcccaaactcagcgtggcccttcgtcctctctccctttctcattcaattggaatcatttctggatagtcggctctgagtctctgaaacccagaaatccaaccagtgcaaataaaattaaatgaaaaattcacattttagccaaagtacattgtgtttatacataagtagtaatgctttcatttttaaaacttttctgataagttgattgtaaatttggaacatacagagaagtagaggaaaacaataaaaattacatgtaaccatagcacccagcatttcttttctcattttagccaactttaaagatcattcatgtaaatatacacttataacagatatgaaaaaacattgcaaaatacaaataccaacaaaattcctgttaaagagaaaaaaataagccaattttgctacttgaaggatctccatcaaattaatgtcacaaaaacaggattttagagaacttccagaatacaagagacaccaacaaaaacacagtaaccacagataaatttacttattacttggacagaggatggatcaagttcagaccggtgatatcctttgtattaactgttgagtctggccaacaacctaacaatgctaaaccaaatactacccagctccgtaatcctctatcacaaaggcataaggaaaagcaagattataaccaaatttctttccatcttacctaataacttgaatgtgcccttttctcaaaggtgtgcacagaaaaagatgactaaatactttttcaaaagtatcacctatgagcaccaaaatgacagcctgggatgaggactgtcaggtcaaataagatgggacatcctacagtgcactttcaccttcctaaggaccactaattttaaacaaattattccacgtaatttgtaaaacgactttaaacaataacaatttgatttttttctaatagtttttattatgatttgaggtttttcttagctgggggttagaaaaacaaaatacaatacaaaaatattaaatattcagatactcagaactaaccactgttaacattttggtttctcatttcagatattttatctggctggtgtaatattgtacatacctaggctatggcctgcttttgccacttaagacgtttcccatgtctttacaagttttcataaaacagaattcaaaaatggctaagcagctagactactgtgtaagtatatacaataggtttcttaaacattcccaaatagtggatgatccgattgtttccaattttaccatcttataaataatgcttatcaataaatgtaggcacctttatgtgtcagtctgtccttctatcgacttgggataagtttctctttttttttttttttttttttgagatggagttttgctcttgttacccaggctggagtgcaatggcacgatctcagctcaccacaacctccgcctcccaggttcaagtgattctcctgcctcagcctcccaagtagctgcgattacaggtgcgcaccaccattcctggctaattttgtatttttagtagagacggggtttcgccacgtttgccaggctggtttcaaacccctgacctcaggtgatccgcccacctcggcctcccaaagtgctgggattataggcatgagccaccatgcccggccgacttgggataagtttctaaacataaaagaaatgcaggtgaaaacgaaatgagtattttaaggcttgacactgctcccctttcctaggaaactgctgtactcccattcctgccggcaggaagcaggagtctgtcctcagcatctccaccaacactgaacacactgttacaaattcgatgagcaaaaacacttatctcattgctattaaaatgttcatgtttgattataaactgcatcaaatgttttgttacacttattagtaattcctctttatagattctaaatttgtttctctgccttatctgctaaggtcttttttattcttgttgatctgtatgatccctttatttattaagaaaattctttgcctgtatttctaactgaattttccttgtcatcttttaatttcatttttaatattttttcatattcaagttttaaatcttttttatttataaagaccattttcacccattaaaaactttaaatcttaaaagcaagcacaaatatttaaataattttaagtgtcatgagtttatattaaatacacagtcagtttagaaaatagcttctctaaaactggttaacaggtcataaatccaaccatacaaaaactcagaagtgtcacatataaataactcaagactaactgtaaccatgcttacctgagaaaggcaggcagtgattccaaaaaaaatctgacatgattctggagaaaaaccatttactctgttttatagttattaagattacaatgaaataagattagtgcaacctgtacttcactaacagacattacccacccactccgtccccactcagtccatttaagaaagagacagacttaagatagacaaagaagagtacagggcagagtggaatagagagtagtgggtggcacagaaagaactgagtgcttttctgtaaagcacattttgaaatccaatctctccacttatatcataaatcaaataggcaaagtatactcacagggggaagccttttgatctctgatagctagctaactatatacaaatatataaacacacacatgcctatacacatacacacaaatggcatagcagttattttaaaagcaaaattaaaacgtcttgtttcttttagattgaaacgttgtgactgcttccactgcacagtaggaagaatccttcataagagcttgattgagctctagttttattatctccgctaactttgtgaacttaggcaagacaactgtgagcttcaatttccccttttttaaaacaaaagttggaatatatgattccaaagatccttcctatttctaaagctgatcttaaaaattcattcaaaatgattaatgagcacttactacacatcacacactgtgaatttaacaagacacaaggcagtcatgatctctatgtgcctgtaattcatagtctattcagagcaaacaatgactttttttgaataatttggagtgtgtagaattcaaaatgggttaaagtattacttctctttccctataggagtaaagtatactgattgagataggtgaatcaagaaaaatatcagcttaaaaattctattccaagtttgaagtctcctatatggttacacagatgaatcctataaacatttgagacttccctggctgtaaaaaaaactctgaagactgcaatgataccttcagccccattatcgaagatctgtttccatcttccaacctaagctcatggattttctacttccaaagacttggggaaatattaataaaggcaaatctcagagtgcactgtctaccagtgagtctcccaggctcccttgtttgtttgtttgtttttgagatggagtcttgcttttgtcgcccaggctggagcgcagtggcacaatcttttgttcttatggataggcaagtaagagctcaaagaagatcccagtggctgggcgcggtggctcatgcctgtaatcccagcactttgggaggccgaggtgggtggaccacaaggtctagagactgagaccatccttgccaacatggtgaaaccccgtctctactaaaaatacaaaaattagctgggcgtggtggcgcatgcctgtagtcccagctactcaggaggctgaggcaagagaatcgcttgaacccatagtcccagctactcaggaggctgaggcaggagaatcgcttgaacccaggaggcagaagttacagtgagccgagatcgtgccactggactccagcctgggcgacagagcaagactctgtctcaaaaaaaaaaaaaagatctcagcttcttaaggagtcttgtacagagaataaatgacctggaacaacaaaatcagcctcttagctctattcccagtctttttgacttcttataaaagtaataaataacgacaaaacaaaaacaggaactaatttccttcaactctttaggctatgtacaagaaaatattagaacttctgagttggagttgctaaagttctacacatcctccaagaagaactgcttgtagaggaatgttttccctatttctctataaatatttcatgataagtttccttccatctgcattgattcaatgggtaataagtgctttcaagagaactgcctggcatagctgcaaaataaaatagagcacatgacataatctcttgccaggtctaaaattttagcaactgtatggtatcaggtacttgcaaaagaaatgatttccacaagcaagttacacttgaagtaacagtcccatgaagaattatccttttaggatgaaaagggagccaccaggcctagaagagtaaacaggaggcctgtagaacgcctcatttctgactcctgacacagtgccagggcaagggcacatctatgaatgctccatgaacgaacaatgcaagcaaggaagctccctgagggcagaaatggtcttcttcacccctctattttcagtactcaacccacagcacaggtgcactgaattaataatcgttctacccaatgcaattaaaaggattaacaatgcatgttataaattttattctcatgttctcttccccaacttactcttcaaacaattcatgatttgattcacatagacttagaattttagaaatatccctcatctagctagcaccacaaaagctgaagagaaccggagctcctgcctccagttcccggcctagagttacttgtcacagctgagcccccttttaacatgagtaataacaaggatcaggtacataaaatttgaaacaggatggaaaatagtaggaatataagatgtagacaaaacaatctgtcctaacgaatgaatccacttttcactccattaactatcatttctttcagtcttaaacccagagttaccctttccctcctcccccactcaaaaaaaaggatacggcagaagagttccacactgaacggacagaatcacccaagaaggctgaaaaagaaaagattaaatcaaaaagtattctcaatttacaagtggcatattattttactagtgttgttcttagaaattaaaagtctctgttacaacctattttaaaacatccagattacaagtatgaatattcaaatagaaatattatagtcaaagattagttactaatacccaagatgaaaaatccaattacagaatgaagcactaccatatttttttaaaattatgtataaacatttaagttccaggtttacacacttattactgctgacccccacatttaggacaggggaactgccacccatcctgccccaccaccgccgacacctcatccagggcatagtcagcctctcatacgctcccttcttgaatcccaaattcagtcaagtctaaattcatgaggtgtttgtttgttttagtgaagtcaagcagatacaatgtttgtaagcctgaaaatatttttataaattctaaaaactgagattaattataaaacagattaattactacctttctgggtaatttatatttttgaaaaattatcttgtttctatgtttaatttttataattatacaaatcattctcctgatagctctacttcagaaaattactatcaaaatgtagtaatgcccccattactacattctggaaggcagctgacttccagaaacttcagccaactgaaacagacatatatactcactacccacccatcaattcattcatcaaatatttattgagaatctattttatgcagagatggtgcaaggcgctggggatgtaacaatgaaaacgagaaacgcagtctttgctctcctgcaagtcatattccaagctaatgatcttcaagctatttttgtcatgtacaccttaaataaatttcagacaatgaaatgccccccttatcattttttagatgacatctaaaatttttcagcataactctaaataagtatattttctgtgagaagaggaatattaaacattttataaaataaaataaagattggcagctgtgcctgggataattacttcattatgatttgacatttaccaaaggttttaactaagttactggattagttatctgaaatctgaaagaaggcacttaatttttcgatctatgtgccttatccaacatatcttcacattttttgatagtcctagaaaaattccagttaaatttaaaaaaatgggccagcatcaggaatcggtattggccttgacacttctgaattcagaacaccttcatgtagaccaagctctcctttcaacagcaacacccagaaacccctctctcctcatgatgccatgactgagcactaagggaacagtccctaaaaccagtctttctaattgtccttttgtctgctgtccacgagaattttcagagcctggggcaatgcactacaagattaggatgggtgaaggtctgattcttcctgtgtaaagtgggaggggccactgtgaccacaggtgtgttctcaggcagctttaggaagggccagtctggaaatgttatctatcaccttacaaccatccacacagcatacacgctgaatatctccccccagggagcttgggtagggtatcccagtttaaagactgctggctatcataaagtcccatccaagcacagtagaatcactgaggccctacttcagataagtttagataaaataatgcaaaattaggatgtaggccacagtacaaagcagaaatggagaactacaaaagcaaagtgataaggaactatttatcctaaaggcaaagaacaatatataaaaataagctggctgatcgcgatggctcatgcctgtaatctcagcactttgggaggccaaggcgggcggatcacttgaggtgacaggttcgagaccagcctggccaacatggtgaaaccccgtctctactaaaaacacaaaagttagccgggcgtggtggcacacgcctgtagtcccagctactagggaggctgagagaggagaatcgcttgaaccctgaggcagagggtgcagtgagtcgagatcacaccattgcactccagcctgggagattctgtctgaaaaaaaattaaataaaataagcccactacaagtcagcaaaattaacatttccaatgatgcccaaaggccactgagaaaaatatctcaatttaaaaaataattttaaaagttttggtgcccaaagaagcaagttttaaacatttataagattcaaatatgtaaatgatagataaactgtcactgtgtataaagatgccttatttttaaaatgcattgtcaaacttcctatcaaggtaaaggccaagggatatgcctctagggaaccaggtctcagccttcagtcatatgaattcagactcaactattagcagcaggatccaaaataagacaggcccataaggttcaaactaagaatatcaggatctacttgaaatatcttagagtgaaggcaaactgttgagtcagctccgaagtactctaccaccttgtaatgtaacacaatagtccctggacaatacaggtgctgtcaaaaattacaagcaggctggaatgctactgggtacagatgaaatatgtctgtcactcattttaaaatactatagccagagggggaaaaagttgggtttgaatacagtaaactaccttggcaaaatggtgataatcctagatgctaactgctaattgtataagtaatgggtatttctacttagccttacatactgactttcccaggaatatgaatactgtgtaaaatgaaggaagactgctttgtttagctcaggaattgatcaccattctgaaatgtcacctcacagcggcgaccccacttgtggggtatgatatcaatctgtaattgcagcagctaccggcagtgactctacatatagcagcagccatgcccaagtgtttacacattgaaatatatatttattatttacttgccttttatttcgccttcacatttcagtttgggcaatttatatatacatattttaaaggttggcttacgtatcgattcatttctggataataaggggagtgctacaaagtacttattacaaaaaggtggtttggggtcaggcaggtttaagaactacttctggtagttggcctggcaacaatcacctaggccccaaggatgtgttagaaagatcaccctttcacataacatctgcataagatatgcaaagccgctttactgagacaatagctccaggctattgtctgagagaaagaaagtttgtaggaaggagaaggaagagacagagatactgtccctaaagcagtacaaggaagcaagccagagacaaaaacatgttccaaagaagagggtgccccagctcaggacctcatccaaggcagtttccgaccctgggtaccagggaggtcaccacttcccagcagccaggtggcttctctggccccgcaatttgacttaatggcaatctttctatttttttccctttttctttttgtttaagagatggtgtctcactgtgttacccagactggagtacagtagctattcacaggtgtgatcacagtgcatggcagccttgaactcctggcctcaaacaatccttccacctcagcctcctaagtagctgggactacaggtgagtcccactgcaccaggctggcaatctttcttaattcctaacactgttattgttaaaccacagtaactttcatactgatttctttttaaggcaaagcatttaataacatgaagagggaaaaaatggtagtggtatagaactattttaaaacaaatacttcatagggaagatctgaaataaaatcgaagcattggaattacaaaatttaacaaatttttaaaacacacattttaacagaagtcaactaacttatcagccataacataatacagtaggtggataaacaaaatctgaacaattcttccactagctgaatccctcattctctgcaataaattacccataggtcaagttggatacaccccagacgaccagtgggtagacaatgtgactaaaggccattgtgactcttgtcagaaaggagttccacaacatagttaatgggggacgcccttcagctaactgaaattcagaacaccttgccacagtcgggatggaaagtaaccctgtcctagagttacctcccgacaggccttagcctgcttttggaatgaaatacactcttacaataattcaaacacccatctgattcaaggcatcagatctgtttcccatgacaggtttccctggctcagaaaacttccaggcagtggtaacgtgggacgagttctgcagcaggcataaaggatggcctaggattacttacgacatacagaagccatgctctaccttggtttagctgaaaggacctgaagctaagggaagttactcagacgttaaagatgtccacagttatctggcaactttccacacaaaacaggactttagggccagcacggtggctcatgcctgtaaccccagcactttgggaggctgaggcaggcggatcacctgaggtcaggaattcaagacaagcctggcccaacatgttgaaaccctgtctctactagaatacaaaaattagccaggcgtggtggcaggcacttgtaatcccagctactcaggaggctgaggcatgagaatcacttgaacccgggaggcggaggttgcagtgagctgagatcgtgccattgcactccagcctgggcaacagagcgagattccagctcaaaaaaataaataaataaaaaataaaaataaaataaaacaggactttagcaaaaaccctgaaaagagctatagtgaaacttcaatgtactgcttgcaagatactgaggaaaagatataaaacaaattatgtttactactgacctttacaacaggtaagtcaaagacttcccgagcttctcccacctctggattgtccccatcctctgagattatgtgtgaggctagtgcattgtaggaaacttccttcgcttttccagccttgagaagctgaataacctaaaaaacaagaaaatccacacaaattaaaatgggcaatactgtactgtactcttgaattacagaaataattattgggcataatagtactttttaataaaaacacaccatattccccacataaaaactaacagccttttactctgaataatatgccaatgaaactttcggggacaatcaaaagcagcaaatcttgattcactgaccaagtcaatgaccaagtaatggaggctattgtgagtccagtagtggacatggtctgtcctcaagacagatgggctggacaaaccaggagacagcacaaccactgctgcggtggggccacgcacatggtgctcctgagcttccaacttaaagactgggacatggggagtttcataattagggaaagattctggaagacaagatatgtgagcagaaccctcataaacgtctgggtgttaggcaaaaatccatacatcgaggaagagggagcagtgttgaaggcactgaacaggtgaatacagagcagaccgtaaatgggctttcttacacactatgcaaaaaagtctgtgcttcattctggggtatatgcagggccactgaaggatttcacacaggaaaagtagcacagatttcatacaaagatgacagtccatgtgaaaagaaaggattgggtgggctggctgtgtttggttggctagatgactaaagacaagagacctgttaagaaacaagtgcaataacccaggtgaaagaggcatccactaaagtgatgtcctgatgggcagaaaggaggaagatgtgagagaatcggcaagccttggtgtctggaaggggtataagcaaaagagcaaagtccagactgaaatggtggtgagtaccactcactgaggaacacatcagaaggctggcaggtggggacacaaggacgtgttttagtttgggcatgccattctttgggggtcgtgttaatatctggcaagaggcatccagttgcagctaggaaaagatgtggatctccctgacagaaagtcatcagcattgttacatagatgggagccacagccatgagcgtgaaggtggtcgcagtgcagaatgggaggggagctagagagcagacacagcaactgatacttcagggacaggtagggaagtgcagtatcacaggagaggagcgtcaacagaagccaaggaagtgagggttaaggaacagtcgacagtcaagtgcttcagaagaggtgggcagtgtctaagctgacagtgcacaccaactgtcaaagtgacatggtgcccacaaagctcaagtgacccaccagggcaacgctcttccaggtcccctctctgcagcagagagctttcttctttcacttattaaacttttgctccaacctcaaaaaaaaataaagtcacccacaagctagacaaccttttcagaatactttaccgaccactaatagatatgaactagagcagaggctcaatatttagtaagtgaaaaaacagcggtcactggccatgggccactttacctttcttccttcccttgacctctaagcatttttagcttcacgcatccattcgactggtcttcagaaaaggcacccctccttttcctatcctccagtctgtttctgatcctactcccttcttcatgagtttccctgtccatagctatgttccctccacctgtaaacagtaaagtcacccacatccttccacgcgcttgtgatgcaacacagatccctccccagccctctcttcctcaggcaccttctctatttccttctcaggacaaacttcctgaagagtctaacctttctgttctcagtttccattcactcttcaactccctgcaatccagccccttccaccaacactctaccaaaaacactttactcggttttcacgaactttgaggatgccaaaaccaatagcttctcttcaatctccacactactgagtatcttaatagatttatctcatatcactctgttccagatatagtgatcatcctgatgtatcccaaacgcatgaatgccttcattcctcagcacatacgctccacatgaaaatattccttcatgttcttaacttctgcttatctcaaaacccaactgaaatgacatctactgagtgacatttcagtggtgtctactttgcaccccagtggagaaatctgctacaccttgtactgtgatatgtccaggtgtgctccctcccccaccaatgaggggcgctaaagggcaggtaccatgtcctcttcacctctgtattatacctggcacctagtccatgcctgcctcatattagatggtcaacatgtgaacttataatccacagtcataagagtcagagaatcagatgtccaggctcaaaacttttcagaaaatatactgtttcagatgaaagtggtttgccaaggacatttttaagcacttagatttgattcaaagtcgagtaaatatggttccagttcaacttgttccaggttttaagtaacatttggttcaagtcccctataagagccaaagtcctaaaatgaaacacgaaggctaggaaggagggggaagagaaaaatggtggatagcaaaaaacaaaaacaaaaaaacaaacaaaaaaaagaggggcgggggaatcatcaatactggaaaaagctaacactgttacaggcactcatcttcatcgctccgtgttcagcaactgttttactctgtaaattcaaagatagaaggctttttttttttttttgagacggagtctagctgttgttgcccaggctggagtgcagtggcgcgatctcggctcactgcaacttccacctcccaggttccagcaattctcctgcctcagcctcccgagtagctgagaccacaggcgcccgccaccacgcccggctaatttttgtatttttagtagagatgaggcttcaccatgttggccaggctggtctcgaactcatgacctcaggtgatccacccgccttggcctcccaaagtgctgggattacaggggtaaacccggccttgaagtctctttaccctaaagttacagggcaaaaagggtccaaaaagttgttacaaggacgaacctcaagaaggccaagatcactcagccttctacaattccttctacaccatccaagttcatctgcgaaatatgagtctccgcccttccaggcctaactctgatcactggggatccccatcctccaaggtgggggccactgatgtcacacccaaggcaacacaactgtacagctaaacttttaagaaggaaatattttgaagattaacctgaagaggatattcaactaagatgcattcctaccacggactgataactgtgtgacatcaaacagatatattattataggaatactaaggaaaacccacaatatcctttggcgtgagcccaaactacacaaaattaaatgtgtaatgtgatggtgttaccagggtaccgtaaaattaatcgtccaagtgggaaaatcaaggaagacgaatgccagcccccacgtgcagggacacaggctggaagggagcgctcctcagccccgcacaggacggcagctgcccgggtggcggaggcggccaagccggtgcacggccacgacccccgccggccgagcgaggctggggtccccgcgcgagctgccccggctggggatcccggcgcccctcgtccgccctcggagctgctctcccgggagccgagacgcccggcgcggggaatggggagacgcgaccccgcgcccgtcccgctcagcaaaggagcagagaacgaggcggcccggtgggtcgggggcggcgaccccagggccgcaggccgggggctcagggcgcgcactaggggccgaggtacagagccccagccgccttccctcccgcactcccccgggcccgggcctcccgcgcccaccccgcggtcgcccctgccctcagcgcagtcaggccagcggcctcggcggacccgacgctctgcgcccggcgcgcgcccgcggcaggagcggggacggggacggggacggggacggacggggacgcggacgggggaggaggccgcggcaggggcgggcgcggtacctgcgggtcgatgtcgcccaccgcgtaatacttgacctccctgaacatctcctcaggaactttgggcgcctggtccgacatgatcgcggcggcccgggaggctccgcggcggcgcccggccccgcccaccccccgcccccggcccccgcggcgcccggcgcccccactcgccccgccaacggccctgcccgcgcagcccgggcccggtcctgcgaatcggggtccgctcccccgccctccgcgcccccgcccgcgcccgcgccgagcgcccgaagcgcgggagccgcgcgcgccctgcgggacgcaccatcccgccccggccaccgagggggagcgccgaggagccgcccggcctccagtgacgccccgcgcctctgccgccagccacggctccggggtagctggcgccggcagcccgctctggcccttgcggttccgtggccgccgctctgcaacgagggggccccgaggacgaggggaaaccagctcccccctcggcggggccggagtgagccggtcccggggaggaggggagctggcaggcccctcccgtcgccacatgcggctgctcgggggcggcgcatgcgcgcggcggaggggggggtggggccttggggccgcgagtgggagcgggagcggttctgcggcctcctcgggcttcttggccctgggcggagtgggattgggtgtcccggctgttcgcagtggccgcgagtgcggccggacctggagtagtacctgagccgctctggccgagcaaggcgcggggccccggtctacaccgcgctggacccggctatgccgtgacggaattcccgaggccgtagcgccacgcgagacgcgcactggtggcctccgcggcgagtcctggggtctccgcaaggcctcagtgcccgagctggggacgtgctggggggaggcccggccccgtcgctgcccgaggccccgctgtcccggccggaccggcctggtccctggcgtcctgtcgggtccgcgctggaggagagtcccagacagcagagcccgcggtgcagctccagccccgggaagccccgcgctcaacaggttaatactacacagcggcgattctaatggtcacgcttttatttacagctcgcctcccttccgccaagattcacagaacacggcagagtggcctcgggatcacctgcccaagacacctgcacgaccggaagttgggagaagaaattaaggccatgatgatgaacgcagcctttctcgtttatttccaatcccacaacaaaccggagtccaggaactcatgggtgattatcggactattacctagtcgtaaaactgtggagcattggtgtctaaaggaatctgagacagacccgcagtgtctcccccacatgccttaagtcacttctgccaagcagaaaatcatttttaagtaaatgttagtgaaattggttttaaaaaagagaaggggccgggcgcggtggctcacgcctgtaatcctatcctttaggaggccgaggtgggcggattgcctgagttcaggagttcgagaccagcctgggcgacacggtgaaaccccgtccctactaaaatacaaaaaattagccgggcgtggcggcacgcgcctgtagtcccagctactcaggaggctgaggcaggagaatggcttgaactcgggtgggggaggttgcaatgagccgagatcgcgccgctgcactccagcctgggcgacagagcgagactctgtctctgaaaaaaaacaaaacaaaacgagaaggctttcaaaattactctgcggtacactaatttaacagattagatcactttccaggctttaagttggcctttgttctaccctttttttagtgtatgataaaagttgtgttggttcgttgatcagcatgcaatgaactctggctcttgttaatcaggtgactacagttttgtccttacatttgtatgtatgtcatgagtggttttgtatgggcaggaggtaaacaacgcacatttaaatatacttaatgatttatcattccaatgttttctggttgttttagtctttcatttgtctcttgaacaatctgaaacatccctattctaaggctaaaaaatttcctttacaaacttaggttaaacattcctaatctgaaatccaaaatgctctaaaattcgaatttttttgagtactgacgtgaccccacaaatggaaaattccacacttgccctcatgtgacactgggtgacagtcaagtcacaatcaagcctggtgtggtgggcacctgtagtgccagctactcgggaggttgagcaggaggattgcttgagcccaggagtttgagtccagcctggacgatatagccagaccctgtctgtaaaaaaacaaaaaccaaaacaaaaaaaacaatgaaaacatttttttttaaaacgccatcaaaactttgtttcatgcacaaaattatttaaaatatataatataaccttaccttcaggctatgtgggtaaggtaaggtgtatgtgaaacaaatgaatttcccatttagacttgggtcccatccccaagatatcttattatgtatatgcaaatattccaaatcaaaaatatctgaaatacttttgtcccaagcatttcagataaaggttactcaacctgtaataaaaacactcagtgcttgcctgaaggaaaaaccaagaatttgtcatccatccttaaatttttatgacaccctttgtaatcaggaaaccttttaatacctaagaatatatttgatatattctggtatatgtttatcattctgatgtttaatgttctatgttgggcatatatcagtgtaataaatacattagatccaaatacagatcatgctgcctttttatcgacctgtgtgagagaacttatttatccttttctttttctttcttttttttgaaacggagtcccactctcacccaggctggagtgcaatggcgtggtctcagctcactacaacttccaccccctgggttcaagcgattctcccacctcagcctcccaagtagctgggactacaggtgcgtgccaccacacctggctaattttggtatttttagtagagacaggttttcactatgttggccaggctggtcttgaactcctgaccttgtgatccttctgcctcggcctcccaaagtgctggggttaaaggcgtgagccatcacacccggccctccctttgattttcttggttaaacacaaactaagcatgtgattttatgttaaaagacctgaagtggacctcaaccaggtattttattttgtgaattaagaaagcaatttgtaacgttcaagagaacaagcttaccctacttcaggttctgatggtaaggcaaattgcgggattaagaaacctgctatttaaggccagcgtggtggctcacccctataatcccagcactttgggaggccaaggcaggcagatcactggaggtcaggagttcaacaccagcctggccaacatggtgaaagccagtctctactaaaaacaaaaattagctgggcatggtggcgtgcacctgtaatcctaccttcttgggaagctgaggcaggagaatcacttgaacccgggaagcagaggttgcagagagcagagatcacaccactgcactccagcttaggtggcagagtgagactctaaataaataaataaatctgctatttaaaaccccatcacctagtcagtatttgtaaaatatcacacgtgaactgtgcaaggcggtccacacaagtggatcttacggcaacagcatcaggaaggcctggaggcagtgtcacactcactcactgagtctccaatactactgcttggccagtaatgaaaaataaaaatgtttacattaggttaatttcatgtggataaaggatgctctgaggcagtctaaaaaactagcatcctgacatcatgaagagtaacccatctagcagaggacgtaaagatggcaagtcaatatttaaaggcaagcggtaaactcagaaattatcttccccaaaatggccatatgcaaagttataggaacaaaatatcatgttgacagtgctgtatcttattcacagttaaataaaattcttatcactggttttgtgacactttaaggatgacccattttagggtgatagctatcagtttattaaacagaagctatgcatttgtttaatttgaagcatataccacttccaaatatgacactgagcattaatatttttagacttcccccaggtaaattaaaagcatgatcattttgttgataatcagcctttggagaattaaacagcctgcttactgccagtgctagttcagtaaatatgtttctcattttctatttggcaaaattagataacctaagcctaggaaaaataaaaaattagaaaaaaaaaagtagatttggggatatttaactcaaattgcccttactggtggaaactcgaggcagttacttagattatttccaaatggctttttttaaatgtatttctatattgtatacaacagtctcagtcttcatctctcctgttcagctatccatacatcccttaaaattagatatttttaatgtttagtaaaccttcagtttgggtttatagacaacatttaaccttctcatgaaagggtcagaatactccagttgcaggcacaaacaggccatagtttagttgaaggagaaactgcgaactcaaaggagcactgcttctctgcaggaaagatcccgtcagtggacctgcggggcacagctgccaccagtgtcatgtagctattcagtgtcggaaaactagaaatcacaagtgaagagaaattgtaaattacctcaaattctatgcccagaagcaaccactatggaaatccttctagacattgtcccgtataaatatatttccctaaaaaaaattataccccatactctgccacttcaaaaaaatcaagactgtttttccatgtcaataaatatctatatcatttaatgaatacataatactcccttgtttgaatgtacaatattctgtattgttgcacatttgttgtttccaatttaacaattacagtactccaatgaagcaatcatcttaaaatacatgtataacgtattataatgttccatcctttaaggttagaaacgacgtcccatacctgtctcccgtcactctgagaacagtgcggtaacaggatcagcgattctcaaccatgggcaatttagccccctatggcacatttgacaacgtctggagacatttttggttgtcacaactagggggtaggggatgctactggcatctagtggtggaggataggaagctgctaaacatcacgcaacgcatgggaccgtcctccatgacaaaggacccgtgcaaaatgtcaatagtgccactgttgagaaacccggattaagatcatgttgtaactacatttcagtgggataagactttgaaagtttccaccgggcacagtggctcatgcctgtaatcccaacactttgggtgcccgaggcaggtggatcacttaggtcaggagttcgagaccagcctggctaacatggtgaaacctcatctcttactaaaaatacaaaaactagttgagcatggtggtgcgcacctgtaatcccagctactcgggaggctgaggcacgagaatggcttgaaccggtgaggtggaggttgcattgagtcaagattgcaccactgcactccatcctgggtgacagatctagactctgtctcaaaaaaaaacgaaaaagaaagtttcttgcacataacgccttggtggcttccttcggacagctttcttccaaatgggacttggcttctgtcatgtggctttgttagctgtacagatggggacaaagcatgtagagtatcctgctgcagtttctatggctgagctagcaagagtggcacacatacctccagccatttccactggccagaacctggtctcctgacacctccgtaagctgtaaaggagactgctgggtgatgtggtcttcttacacgtccaagaaaagaaaatggcattgatggtatcttgccaatttttgccatttttggttttcaaaaaaattcttatatgaattaagattagtgtaatataaaacaaaattctcaaagataatttcaaaaaaaatacccgttagctactcaatagatatttgttgaatttgaggttactggctttatacatagaggattaagcgtattctttttcccgcctggccaaatggtaaaaccccatctctactgaaaatacaaaaaaattagccaggcatggtggtgcacgcctggaatcccagctacccaggagactgagccacaaggatcgcttgaacctgggaggcagaggttgcagtgagctgagatcatgccagtctgggccacaaagtgagagtctatctcaaaaacaaacaacaaagaaacagcattatttttaaaaagcaaacacaaggtagttctctgaggcatgtgagggatgtgttagatgccttccatttgtcccactccccatgtcagatctgtactccatcctgctccacctttttctccgcccctgggtgctgacctgagcagattatataagtagaatcccttgcacattggcttctagttgaatttggtcaatggggagtcccagcagaaagctgggcagtgaggggagggaggagagaggtatgacggtgtttatttcccaggttcctcatcaggttgccttgagctggcagaggagcccattctatacaactctctccttccaggtcctgggaatctttccttcctctcatcccttggacctagggtggtgagggctcacctgcttctccccacaggtcccttcactctccatgcatcctgcctacacctttgtaagtagttccttgataaaccttcttagatgattgtaatttgagtgtgctgcccccagtggtgaccctgttgtgatggacaggaaactcttacagggacaatgagaaattcttaaaatattgtgtctgctctcaaaaaactaacaaatacttggatgcacgagcctaacactagtgggattctgtagaaatgcagcagagatttagaaaagaggttcccatgtgccagaatagctgggggaaacctcttggatggagcgggctgaggggaatagttcttgaagggagaggagaaaccactgaaaagaggccagaatactgatattgccaaataaaagggtgcacattttggatattaaataactgatgatttaagatagaaatggggagtaataagaaataatagactgtgtctagcgtatgaagatcttgagacctcatcagaggaagttgttgcatttgagacttagcataattctgtggctgtgaaaacagaaaagaaaattgcttaccagctatttaaagttaagtactttgtgacaagctggctgtgggattgactgtttactcatgttgtgggtaaacaagaagacatattgaatcttaactcagattttaaccgctggtacctgtgagtgtgaccttatttggaagtagggtctttgcccccatcattaagatgaggtcctactggatgaggatgggacctaaatcctgtcactggtgttcatataagaagaagaaaatttgaacacagacacccaggagagtgccaagtgatgaccgcgacaagggttggggtgacgtgtctagaagctgaggaacaccaaggttgcggcagacaccagaagctggaagaggccaggaccgcctctcccctaacgccttcagagaaagcacagcctggccaccaccttcatcttcgatttctggcctccagaactgagagaatgaatgtctattgtttaagctgccagtatgtggcactttgttacagtagccctagcaagctaacattcagtatgtctgaagggtagtcaagaggaagctagaaattaagatgtcggcccatgtttggagtggatttaagccaaacagcgtactatgtgtgccctgctaaaaattataataacgagaaattgttacagcctaagagtgaccccaggatttgtaactgacgttgagtgcccaagaactgcgtgataagtctattaagataaaattatttcaagtcctcactttcgtttctttacgttttctctcttttcctattagcatatacacatccagtggtcatttgaagcccgggtgcgtcaagtggtaaaagctttccctgctagcttatgctgtgggaactaactcccaaagttcagtggcttcaacaaagctcgcttctcactcatgtgttgggcaggcgtggctctgctgctcttttttctggaaactctgcagaaggcataggcagttctagtgaccaaggggaaagaagaatggcagaaccgcgtaatagctataaaaattctctctggaattcacacacattccatttgaaagtcagtctcattgccaaacctgatgtcaatgtggaagtgaatctgttcctgccacaggaagttactccaggtcatggcagagtgggcaggggtatgtcatcctcttcctgggaatacagcaggtaactgaggacagcagtatgttctacccatgttccctctcagtcacaaatgtgaatgtgtgtcccttctgcactccacatctgtgtcttttgagaagaaattgcaaaaattccactcaattatagcatcaggcccaaagtgcaggcactcatgggggcctctacagcaactctagatgtgtcttctctcagtctagtcacagatggatgcccgtcttccccgacgtgcggtggagctgggaaagatcactccattgagaacagggagaatgaatgcagcctgacccagtcactggtccagagcgctacggacatccccgtgggtggatgtgggaagggttccccacctcaactgccactaccagttaaacttcaataaattacgttgcagctacacaaaacttctgaatctcatgagtctgtgctcacaggcacaagggtgaggttcgaggagttagcttgtgaagctacttgatcactgcggggtgagaacccatgggtaaaagctttcctttctttgccccattttttgagacatttcaccaggctcctcagaaaaggccccattgatcttgcactgagtcccattgggtggccagtttggtcacacatcccaccctccctgtttcaccccctgcacctgcacccctgctccctggggtcactttcccagttaaacaatttgcacacaagcccttgctcaggccctgctctgagaggggcaattcagagaacccaagccagagccaaagcaagtcacaaggtgaagcccgcagtgaacagggcaggaactgtaatcctacaggaaagcaacccatggtggggaacaacacgcaacaagcgactgcagtggaaaagtggtgttgtggctcttgtttctttggttgggttttggttgtggctaaaggcacagttcacagtcctccgagagcatcttaagagttaggataatgccatggtttctagtacatcacagtggactttcattattcagaactgtgtcatctgcccagcaagtaattccctatagttttccagaaagcattaatatgtttaccaattgctggttctttaaagttaatgattcttcacactgtgttatctacatttgtctggggcagctaaattactcccagtaactttgcacacacaactgagcactagcttaactgacatcattaggtggcatctagaagctgtacttgttcagattctgtgaaccagcagggagacagcccagcatgggactcgtacctgcatcttctcagaaagaggcgtgtatacacagaggaacggcttcttttacaaaacagttgatttagacctaacctttgtaggtctagcatagagatggacaagtcctaggactaaaacgaaaatactaatctaggaaataacaaaattttctaagtcaggagtggccagcctgtagggtgattgaagacttctattgtttcatttatcgcctttgaagcatgtgaaaataaaactgttgtcacaaattgtattggtcatttgattaaaaacacccagcagcattaacatgccaattgaacacacttgtttacactaattaaaaaatgaatgaattaaggattcaagttttggagaagaaattgtgccccatctgcttctactggtgctttccaacaccttaattagatgggctacacttaattcctgtgggagttcctaggtcccaggtgtaggaaatacacactgaagtaagagagtcctgaaatttgggagattccctgcaaattggggctactcaccttcctgtaagcaagaccaagtgtctatcgaaggtattctctgctggcaaatgatttatggcgctggcttttgggaatccgtattcgctcaccgactcccaccccgcagagtgcaccacgtgcttgtcagttgcatggagcctgagaacaatgtaaaaaaatactcctggcaggatacctgcttagatattttcaagcttagaaaaatcattttttcacacctgtaatcctagcactttgggaggccaaggcaggtggatagtttgaggtcaggagttcgagaccagcctggccaacgtggtgaaaacctgtctctactaaaaatacaaaaattagccagttgtggtggtgagtgcctgtaatcccagctacttgggaggctgaggcacgataatcacttaaacccaagaggtggaggttgcagtgaaccgagagcatactactgcacttctagcctaggcaacagagtgactctgtcttaataagaaaaaaaaagaaagaaagaaaagaaaaattatttttaatggcaccaagcaacccaacctttttctttatttggttgttgttctgagacatttcccagaggttaggaatttatatccaaaaataatgttgacaggcatgacagtttggggttgaagagagaattgggcttgtttgcaaaatctctttaatttatctcagacatttcaccagctaattaatgaagatcccaagccaagatctagttctgtatcataacaccctgaaaagattttaacagcttctctaactctaactgcctcgtctgttgctcctgtttaacactgtgtccgtctccaagatgacgggagtcaatctcacttctttcagagactacactaaggttgagaaaggtgaggcccaaggaattcaagtgagtttctcattgtcacagttactggcagagtctgggttacgctctcctttttagacttattctaattcattctttaaaaacattgaaaggaaagagttttaatttcatatacaatagaaatagaaaagaggaaaactctctaaaagtaatatttatactacggaaaaatctaactttattttggttgaaaagagtatacagatttatattttttgtagctaatacatatttctcttttggaagtggttgaagtggaagagacaattttatgtttaatgtctcgcgtcagttttaattttctgatttaattagtttcctaattagaaggggttaaattaattaacctcattatttactatatatttaatgatttctcatctatggggagttacttaattttcaataattggaaagcttatgacaagaggggatattgccaagtcttacacttattgttttatgatcagtggcaggaataagacagattaaggggaattttaggtgagatatcagatacttgcaaaggtatttcttacttgttttgaaccatgatgcatgtaaaaacttgagttgagactccataatttctgtccaatttgaactcaatggatatgtcctttgtttaaggataaaatacatcctagaacatagacttctataagaaatagccctgtcacatgatctcagttatagacaataaaataatcatgatgcatcaaataatactaaataattataatgaaaaggagagcttctgaaactatcatctggtataaatggcataataaaatatttagtttttcctcagacttgccggtggactaaatggatgacattttgggaagaaataacagattgataagcctagcagctatatggcttgaggaaatcaataagccatgttatttcatgtttataaatacaaacaatttgtggataactatgttttcatgtagtgatgtgttttccgagagcaaaaatgaggctgcatctacaaaatggctgaatttgccttctcttcccactttagaagggcctctgcacggagatttgagcagccagaactctgcaggcagacacggacagagagaggacactgttgcccatttctccctgtctctgcattgctccttatccacagcaccactacctgggagagaccctgatccatcaagaggttatgtgagtaaagcttgggtactggtatggtttaaaacacaagcccaacgcatgtagtccagtgaagtggtctgatgataggaaatccactgtagttgaacaaacctgtactgagcacgtaggtgcattgcatataggctttgtgttgcagtcaaggcccgtccatggagtgactgagttccagcctgtaagcagcatatcaaatgccaacgtgagttgcatagagtaatggaatacaaagtgtgagatgcgacggagacagggatgttttgggaggttgtcttagaggaggggtcttgagagaccttcgaagatcaacaggaagagaaggatgcctgttccctgtggaagagaagcctgagcagaggcctgggcttgggaatgagcatggtgggctggcaggactagcagtcagctcctgcctggaggaagatgttgcgggatggagcgcgggagacatgtacaaagaagcagattggagaccttcggggaaaagctttatatgaagaaatgactgtccatatttctcataaattagaatcctactattttcaattcctatcaaaaaaatttacaggctgaagttgagacagtaaaaactggtattccatttgattccatttggaaaatatctgcccttattctgtttattttattttatttttattttattttttgttttattgagacaaggtctcaccctgtcactcagggtggagtgcagtgctgcaatcttggctcactgcaacctccgcctcccgggttcaagcaattctcctgcctcagtctcccacgtagctgagagtacagacacgtgccaccacgcctggctaatttttgtatttttagtagagacggggtctcatcatgttggccaggctggtctcaaactcctgacctcaagcgatctgccggcctcggcctcccaaagtgctgggattacaggcgtgagccaccgtgcctggcctgcccctattcagtgtataatagcaggcaaaatagtgctgctagttccacaatatccaaaaaagtactagctagacaatgctgactcaatgctctggttccaaaatgtcccatagtttcccaccacttgtagactgaagttcagtcaccttagcctgcctttcagagaactctctaagctgttgctttccaccatacaccccacctttgtacaccgtagcccgagcacactaggcccatgtcctcccactcttagcagactagactacagcacttgactctccaaacacatccagaactttcccaccgcagccatggctgtgttccatcaccagcaaccctctgcactcatgcacctgcacaaatcgcacctgctcttcctatggccaaccttagatgtcccattttatgaaacatctctgatgccttgagaaagaatttctttggtctcttctactgtgatttacataaatataaatgaattatataactggcggctctttggcttggatcaaggatgactaactcaaccacatgtgagagagttcatctcacccaacataatgtctggtgtggtgctgctgtgaaccattttcagggtaaggagtacaaacaaggctggagggagcctcaaatgtgagagcttgccttcatcccaatacttatatttaaagtatcaaaaagactgtattctaaaatactttgccattgcatcaccaccaccaccccactcccaacccctccaagactaaaacaagtttttgtttttaagacagggtcttgctctgttgcccaggctgaaagtgcagtggcgccatcacagctcactgcagcctcgacttcacagcacccaagggaccttcccacctcagtctcccaagtagatgggaccacaggtacacaccactggctactttttacattttgtgtagaaatggggtctcagaccagctacggtggctcatgcctgtaatcccagcactctgggaggctgaagctggtggatcacttgaggtcaggagtttgagaccagcttggccaacatagtgaaaccccgtctctactaaaaatacaaaaattagtcaggcacagtggcaggcgcctgtaatcccagctactccaggaggctgaggcaggagaatcgcttgaacccgggaggtgaaggttgcagtgggccgtggtggtgccactgcactccagtctgggtgacagagcaagactctgtctcaaaacaaaacaaaacaaaacaaacaaaaaaacaaaaaaactaaaagggaaatggggtccactggttgcccaagttggtctcgaactcctgagctcaagccattctcctgccttggcctcccaaagtgctaggatatcaggcgtaagccactgcacctggcctaaaacaagttttattttcccttaacacatattctcttccatatttagtatgaggcctgatgtcaaatggatgatgagtaaatatttaaggagtggatggatgcattttgaatgaattaacatcactgccagggatttttcaccttttagggcctctttaaagataatcatcagaatacaaatttaaaacttattctaataaggtttccttgttctatttcattatactttacagctggggaaacacgtttgggaaggttagatcaggggtcagcaaacatttttctgtaaaggcccagatagaaaatattttaggcattgtggtttatacaatctctcttgtgacttctcaactctgctattgcagtgtgaaagcagccacagacactctgtgtaaaaatgagcaagactgcgttccaataaaactttatgtacaaaaccaggtagcaggccagagttagcctttgggccttggtttgctgaccctgtgttaggttttccaaggtcacacactagcaagtggaagaaacaaagaaagactaaaacccaacaggtgttcactaactaatgagcctcttgacccccgtacagcactctccctgcttcactgtgataactctgcggtctcaggaggtctgtctgaatgcttgaccatcaggcaaacaagggaattagggctaattaattagtcaagactttgaaatccactgagaaatggggcctcatattaagtgcaaactatcatcctaagtaatatatttgtgacactttcattaaattttctctcaaatcttgaaaaataagtatctcctagctgccaagattttcatcttagcgtaattatgaagcctccccaaataatcattttccagttggcgatactcagtggggcacaatgccagctgtggagactggatgacgctgtttaatttgagacttattagcacagcacaggtgaaaatgaagaaagtcttagtgaaatgtgctcgtcgcatgttcaatataaaagcttattgtttagtggagctcatggaataaaagaagagcagcaatctaaaagcaggtaattcaatgtctatcaagataaatataggaattttagggacattttccacaggtattaatagaaaccatttttattaggaaaaaggcagatatttcaacgttataatcattttggggggaggggcggttcttttttttttttttttttttttttggagaccgagtatcactctgttgcccaggctggagtgcaatggcgtgatctcggctcactgcaacctccacctcccaggttcaagcgattctcgtgcctcaacatcccgagtagctgggactacaggtgcccaccaccttgcccagctaattttttgtgtttttagtagagatggggtttcaccatgttgtccaggctggtcttgaactcctgaccttaggtgatccacccgccttggcctcccaaagtgctgggattacaggtgtgagccactgtgctgggctggttttgtttttttgtgacagaatctcactctgtcacccaggctagagttcagtggcatgatcatggctcactgcagcctcaaactcccaggctcaggtgattctcccacctcagcctcccaagtagctgggactacaggtgcttgccaccatgcccagctagttttttttttttttttgagatggggtttcaccatgttgcccagctggtctgaaactctggggctcaagcaatccatccaccttggcctcccaaagtactgggattacaggcgtgagccaccatgcccagcctgttttaaccattttaatgaacaacatatacaccaaagagaaaatggtcacaaaatgaggtgtgtggctccttaaatgaattaaaatacatttttaaagtctttttacatgaataaatatttgagctttaagcttagagcaaatttagaaactgcaaatctaaaagggcgtctgtgagtcacttcttgttatgaactttctattcccagttaattctcaagacaaattttcaaagatgttataaacccaaccatatagaatttctaacactgtgctacatttcattaatagggttcacaagtaattctctccttggtggtaaattggttcattttttttttcatttaaaaacatactactccttagaaagacaaagaccatagtaagaatattatcagtcggctgggtgcggtggctcacgcctgtaatcccagcactttgggaggccgaggccggcagatcacttgaggtcaggagttcgagaccagcctggccaacatgatgaaaccccgtctctactaaaaatacaaaaattaggcgggcgtggtggcaggcgcctgtaatcccagctactccagaggctgaggcaggagaattgcttgaacccaggagatggaggttgcagtgagctgagataacgccattttactccagcctgggcgacagagttaagactccatctcaaaaaaaaaaaaaaaaaaaaaaaaaggaatattattggtcaagaatatggaggggaaaggatgaatcaaaaagaagctcacaggaaagaagcatgcaggctgggtgtggtggctcacgcctataatcccagcactttgggaggccgaggcaggtggatcacttgaggttgggagttcaagaccagcctggccaaaatggagaaactctgtctctactaaaaatacaaaattagccaggcatgcctgtaatcccagctacagggatgctgaggtaggagaatcgcttgaacccaggaggcagaggttgcagtgagccgagatcatgccattgcactccagcccgggcaacaagagtgaaactctttctcaaaaaataaataaataaataaacaaataaataataaaaaaagaagcgtgcattgattgggcagccttgactttctgctatttccactggcatataagacgccctcattggatgcctgctgagaacactggtgtatcgtcttgctcctgttactcacacgctcacatagaggacagcgtctgcaccatacctatggagggaaaggaaaataagactatgaaaagcagagacaaaaaacagttacgtttacaacgctttgtccaggcaacattccagtgattcagtgatttaatagagtcccgaataattttgatacctttctaagcgagataatttacttagtccatttacctatatgaggaagctatgtgaactttaaaagaagtattttaaaaatcaggggaataggcagatagtgttggattcagctgtaagttccattcctgcaaagatgttcagcgtattgggtatgtgttgaaggagaggaaaaatatctctccttctccctttctaagttttcagctgggctcctgtagcgaaagacagattgacaacagaaaagtatacaaattttaaaagtcttacatgacacaggggccttcataagaaaatgaagacccaaagaaatggtgaaatctgagcatttttatgctaggtttgatgaagagcaacaaaggggagaagtgagaggacaaagggtctgagctaagcacagtgagcttgacagtaagagcgctcttttccccggagtctagggagggcgcctcttccctgaggaactaatgacctccttcaggggagaagagggaaagtcagactccttcctgccatttctcaaatgcctgcagcttaaaatattcactatgtcaagctgtcctattttggggtagcaggtcctgaacaccactgtagagaaacgtcataaaaactggaactagggctgggccgggtggctcatgccttttgggagtccgaggtgggtggatcacttgaggtcaggagctcgagaccaacctgaccaacatgatgaaaccacgtctctactaaaaacacaaaaaaattagccgggcatggaggcgcgcatccatagtcccagctactcaggtggctgaggcaagagtatcatttgaacccaggaggcggaggttgcagtgagccctagatcatgccactgcactccagcctgggcaacagagtgagactctggctgctggttgcccatttttatggttatttcttgatgataagctaaacaaggggtgaattattcatggttcccctttttagaccatatagggtaacttcccgatgttgccatggcatttgtaaactgtcatggtgctaatgggagtgtagcagcgaggacgaccagaggtcactcttgtggccatcttggaatgggtaggttttagccagcttgtttattgcaacttgttttatcagcaagatctttatgacctgtgtcttgtggtgacctcctgtccatcctgtgacttagaatgtcttaaccgtctgggaatgcagcccagtaggtctcagccttattttacccagttgctattcgaaatggagttgctccgtttccaatgcttctgacactactcctatgccctgtgattaaagacagtagaaaactacaacctatgactagtcaaggtgcttgctgtgggcaaaggaaatatggactgtgtaacggaagaaagtagctataaattccaattaggggccgggctcggtggctcacatctgtaatcccagcccttcgggaggcagaggagggtggatcacttgaggtcaggtgttcgagacaagcctggccaacatgaaaccctgtatctaccaaaaatacaaaaattagccagatgtggtggtgcgtgtctgtactgccagctactcaggaggttgaggcaggagagtcgcttgaacccgagaggtggaggttgcagtaagctgagattgcgccactgcactccagcctggacaacagagtgaaaccttgtcttaaaacataaataaattaataaattccaattatgaccacatgactagttgcagaaacaaaggctgtcacagctatgagtgtttcttccttatttcgctatgaagatgtatatgtaggtatagccaatgttttcttcctttctcatcttccatccccctgcaatctaacataagatgtgtaaagtagttaacctcatatctctgtgtctggcttataggatgccaaagggggaatgtaactcaattagaagtggaagcagcagcatctaactttgaataaagggtctttgtatccagttttgggggacagaattgcttgtttttagttgtatgaaggataatggctttatgataggtggcagaagcatggttttgcgaccatctatatttggaagttaagcatggctgaaagtggtggctttgtatgccaagtcgacaaagggacgatggtgctggaattgcgttgtgtcaatttagccaagtaggagctacatttcccagagttcccttctctgcatggtttggggttagcatgggccacagagatgtctgttgaagatttggaaggcagaagtggaacagcagccattctcttttcaccttctggaggctggcacggggaccccaggcaccgccccgacacacacatgttgttgcttttctgtggctcccaggcctgggctgggcagcagctgggcccacagctcttcctgctcccgtgggatcctcctgaagcttttccacctcctgggccaggtgagtgtttaagtcctgcagcgtctgcattgagccaccccttccctgaaagcgggaggactggaggcagtgagagcctgatgagggttccagcccagactcccttggcttcctccacttcactcttatcttcccttcctgctgcccaccctgtagacttcagatgccaatcccagacagactcaacagcctcacacagatggtttaatcagccacacaaggctctgttgccaaaatacgttctcagtatatcgccttgttgccctgtttctctaattgagcttggattcagggcctgtgacacacaaattcacccacatctgcagcttccctcctgccttccctccaggtgcaatagggaaactgcacttctaactctagagctttacatcttcccccaaccgcctgtatcctcaggagcctgttactcattccttctcccttacatattccacccttcttaatagaatcacccaaaaagcttttaaataagctagtgcttttaaacatccccactttatacattccagacttcccctccactccaaatctccttcgaatttctctccctttcttcatagtcatatttctcaaaagagttgtttatatctactgtttccattttctcactaccaactcttcaacccatgctaatctgacttccactgacccactaacacagttctcaggggcacagtggccgccatattattaaattcacagacaacattggcctttgtcctactggtgtccctcagcagccaatgacactgttgaccttactgtcttttttcaaacactctccttccgtggcttcctggacaggacactctcctggctgtctctctggctatacctcctctgtcatctttgcagatatttcatcccctatgcagctcagcaagggctcagttcttattttgcattctctccaaaactctctactatgctgcggtatcagttaccacctgtttgtatccccttaaatttcatatgttgaaatcttttttttttttttgagacagattgtctctctattgcccaggctggagtgcagtggtgcaatctcggctcactgcaacctccgcctcttgggttcaagcgactctcctgcctcagcctcctgagtagctgggactacaggcatgcaccacaacacctggctagtttttttgtatttttggtggagatgtggtttcaccatattggccaggctggtctcaaactcctgaccttgtgatccactggccttggcctcccaaggtgctgggattacaggtgtgaggcaccgcgcctggcccatatgttgaaatcttaactccacaaagtgatggtagtagaaggtagggcctttggaagatgaccaagtcatgaaggtggagcccttctgaatgaaattgtgcccttctaaaagacacaagagagctctcttgccctgtttctccacgtgagggtagagtgagaagctggccctctgtgaatcaggaagcagccctcaccagctgccaaatctgctggcacctcgatcttggacttcccagcctctggaactgtgagaaataaacgtttactgtttaagccacccagtctatggaatttttgtgatagcagcccaaatggactaagacaccaaccctacacaggcaactctcaaaggtacatatccagctcaaacacttttctgagctatagtcctattccacttgctatttaacatctcctcttgctcaaaagcactgcaaactcaatatgccccaaactgaacttaatttctatgctaaagcttgttattttctagtattttttgtatctgcgacaggagccctccatccagttacacaggccagaaacttagaccttggcacctccacctctcccaccctccctggcctatatatagtctgttcctaatgattttaccctaaatatctcttgggtggtctacaacccatctctgcctgtccatgtgctcgtactccaaactctcatcatcattgtgagcctggactatgacagtgacctcccagccattccacctggctaggtgaagtaagctcactcttaccttccaatacattttccacacagagccacaccacattttttttcttttttttcttcttctttttttttttagactgagtttcactcttgtcacccaggctggagtgcaatggcgtaatctcagctcactgcaacctctgcctctcaagttcaaacaattctcctgcctcagcctcccgagtagctgggactacaagtgtgcaccactacgctcggctaatttgtttgtatttttagtagagacggggtttcaccatgttggtcaggctggtatcgacctcctgacctcaagtgatctgcctgcctcggccttctaaagtgtggggattacagacgtgagccactgtgcccggcccaccagaccatatttttaaaatacagatctgatcatgttgcccctgctttaaagtatttcagtgatgtcctctattctgtggcccaaaggctatgagtgaaccagtccttacagactgcaccagccacgtctcctacccactgtctctgttattttgtcactctagtcgtattacactccttgtcattccaaatacctcctgtgctgcttcccattccagaacatgctttctcacgtccccagatgctcttccctcctcttttcacatgactagttaattccagtcgtctttcagaatgggcgcggtggctcatgcctataatcccagcactttgggaggccgagtcaggtggatcccctgaggtcaggagttcgagaccagcctggccaacatggcgaaaccccgtctctgctaagaatacaaaaattagccaggtgtggtggcacacacctgtaatatcagctacttgggaggctgaggcaggagaatcacttgaacccaggagacggaggttgcagtgagccaagatcacacctctgaactccagcctgggtaacagagtgagactccatcttaaaaaaaaaaaaaaaaaaaaaaggaattatgcacaagcacttgctgaaggaaacttttctcagtttagttaaatcccctgagctctcttagctcctctgctacagcacctaccacccctctcatgttttaacagagacaggattccactatgttgcccaggctagtcttgaactcctggactcaagagatccccccatcttggcctctcaaagtgctgggattacaggtgtgagccaccacacctgacccattctcatttatttatttgtgtgatgatttaattaatgtgtgttcacctggctaaatctacatgccatgaaaacagagaggatgccttaatatttttgtgataatgtatcctccagctcctgcctcagagtctggtatgtggtagatgcttgtatgtcagttctatatcaataaagcacatgctggctaacttattccaaaagggagtttgagaaatattggatatctcactaaatggatgggttcccagaaacatttgggaaccagggcagctcttgataaggaggtgtcaggaactagtcagtcaaatcctccaagggctacagtcccacaccaaccatttagtaagtgcaggaatcaaagtgggggaacacagggtctagttgagccatgttcctggatggaggattgcaggcaccttaattgagagtcccaccagtgcttcacacaatgggcatggagtgggcattgagatatttcccccagaggaaactggggagcccggttaagaaggaggaagggatgttgacaaccaaaacaatgaatgttgagtgggccttttactctactatttcctaaatgctttaatgccttggctctttccatcttcccttctctctagcatgcatttctcctgctcttcatgagagcatttctaccatcatgcaaatatcctccaatatctgccatctttttcttttttttttttttttttttttgagatagagtcttgctctgttgcccaggctggagtgcagtagcgtgatcttggctcatcacaacctccaccttctggtttcaagagtttctcctgcctcagcctcccaagtagctgggactacaggtgcgtgccaccatgcctggctaatttttgtatttttagtagacggggttttgctgtgttggccaggctggtctcaaactcctgacctcaagtgatccactggcttcagccactgaaagtgctgggattacaggcatgagccaccacgcccagccagtgtctgccatctttaaaaacaactgcaaccccttcttcctgctttagaggatatgtaaatgtttgagtctttgatcccagctctttccatgactgcctctttctcattcattcatgattgaatgtcacctttcaggcagcttcctaaacatgttatttaagcatcacctttccacccacttcatttggtaaactaatgaatgaatgagaaagcacacctgtgtccttcctctgatcagtgtcccattgtgtggttttctttgcctaccagatgcacctcttttcttatgttgttcaggcatactgtgtttcacacactaaacctcctgcttcatattagagtttgttagaagtgtattgaaacattaatatgatgtaggtttggggtaaaaaatggaaaataaatgaatactggagaagtatccaactctctatgagagtaactcctcatgaggagttactgttaaatcaatttgtctgtgatcttactttggaatatatgaaatggaacaaattgttgttaaagcagtttgaacttagatggcttggcttgtacacatttgtagtttttctcttttgctgaatcctaggcctgttttataagttaggtttcagtttcagtactctgcagataacaaaacttccagccttgcaagttatcaagctgatctgcaagttaagtaaatgccagccagcacaaaactcagtactctaaatacagaaacaaagtttagcctggcatggtggctcatgcctgtaatcccagtactttgagaggccaaggcaagaggatcgcttgaggtcacaagctcaagaccagtctgggcaaaatggcaagaccccatctctacaaaaacattacaaaattaccaggcatggtggtgcatgcttgtagtcctagccacttgggaggctgaggcagaaggatcgcttgagcccaggagttcaaggctacagtgagctatgatcacaccactgcactgcagcctgggtgacagagcaagaccctgtcttttttttttttttttaaattcttaatttttgttggtacagacacactgtcttaaaaaaaaacctcacaaaatccagatatttggagatatgacatttataatgcccagcatccaataaaaattactaggcctgtgaagaagcagaaaattgtaatgcataaccagaaggaaaatcaatcctttgaaacagatatgtaaatcagacaaattatgaaattcacagataagcatttaaaaatgtctattcaatgacttttaaaaaaacatacatataatgaagaaagaaatggaaactactaaaaaatgatttttggggctgggcgtggtggctcatgcctgtaatcccagtactttgggaggccgaggagggcagatcacttgaggtcaggagtttgagaccagcctggccaacacggtgaaaccctgtctctactaaaaaacagaaaaaaattagctggatgtgatggtgcatgcctgtaatcacagctactcaggaggctgaggcagaagaatcttgaacctgggaggcggaggttgcagtgagccaagattgcatcactgcactccagcctgggcaacagagcaagactccatctgaaaaaaaaaaattgtagttttttgggcaactgatttgtactttattgagatttcttaatttaaaaaaaattaatatttaatttttgtgggtacatagtaagtttatatctttatgcagtacatgaagtattttgatacaagcgtacaatgcataataatcacaccaggttaaatgaagtatccgtcacctcaagcatttatccttcctttgtgttgcaaacaatccaataatactctttgagttatttttaaatggacaataaatcattgtttcctatagtcaccctgttttgctatcaaatattagatcttattccttctatctatattttagtacccattaaccatccctcgccccctcattctactctctatctttgtatgttcaattgttttaatttctagctcccctaaataagtgagaacatgccaagtttctctttctgtgcctgacttatttcacttaacataaggacctccagttccatccatggtgttgaaaatgacaggatctcattcttttttatggctgaatagtacttcaccatgtatatgtaccacattttctttatccatttgtttgttgatggacatttaggttccaaatcttggctattgtgaataacgctgcagtaaacatgggagtgcagatatctcttcaatatactgatttcttttcttttggatgtgtacctagcagtgggattgctggatcatatggtagctctatagttttctgaggaactccaaactgttctccataatggctgtactaatttacattcccaccaatagtgtacgaggattcctctttctccgtattcttgccagcattctttatttcctgtctttgggataaaagccattttaactggggtgagatgatatctcattgttttgatttgcatttctctgataatcagtaatgttgagcaccttttcatatacctgcttaccatttgtatgccttcttttgagaaatgtctatttagatcttttgcccatttttcaataagattattagattttttcctattgagttctttgagctccttatatattctggctattaattccttgtcagatggatagtttgcagatattttcttccattctgtggatcgtcactctattttgtttattgtttcctttgttgcgcagaagctcttaaaattgatgtcatctgatttatatatttttgcttttgttgcctgtgtttacagagtattactcaagtaatctttgcccagtccagtgtcctgaagagtttccccaatgttttcttttagtagttttatagtttgaggtcttagatttaagtctttaatccatttcgacttgatttttaaaaataagatgaaaaataaaggtctagttttattcttctgcatatagatactgagtttcttagcactatttattgaagagactgtcctttgctcaatgtatgttcttggcaccttgttgagaatgagttcattgtagatatatggatttgtttctgggttctctattctgttccacaggtctatgtgcctgtttttatgccagcaccatactgctttggttaccatagctttgtagtataatttgaattcaggtaatgtgattcctccagttttgttctttttactcaggatagctttggctattctgggtcttttttggctccacataaatttaggattttcttttccatttctgtgaacaatgtcattgataatttgatagggattgcattgaatctgtagattgctttaggtagtatggacattttaacaatatgaattcttcaaatccatgaatatggaatatctttccatttttttgtgtgtcctcttcaatttctttcatcaacatttgatagttttcattatagagatctttcacttccttggttaattcctaggtattttattttatttgtagctattataaatgggattactttcttgatttctttttcagattgtttgctgttggcatatataaatgccactgattttcttttctttttttttcaattttagttttttaatttttttttaattttttaattttttttagtatttattgatcattcttgggtgtttctcagagagggggatttggcagggtcatagctgaaaaacaatgatcatcagaaccttagttcctgtcaggcaaaatcaagaagcctcacatacatatagttggagtcccagaaagagagaaaaatatttgaagaaatgatggttattttccatatctgatgtctaatgtgaacccactagaagccaagcacaccccaagaagaataaaccaaagaagataactcagataactccaaggcacatagtcatccaatagcgcgagccacaaactgggaggaaatatttgtgattcatgtatctgacaaaggacttgtagtgagaaaatatgaagaactcctaaactcaacaataagaggacaacaaactgaaagctataaaagtggacaaaagattagaacacatattttacaagagaagacatgtaagcacctcaataaacacatggaaacttgtctaacatctttattcattagggaaatgcaaattgaagttataagatgctacagcgtgtccaacaaaatagctaatattaagataacaccaaatgtggcaaagtgtggatcaactggaactctcatgcattgctggagtcattggaaaatagtgcaaccactttggaaagagatctgagtttcttacgaagctatatatttaccatatgacccatcaattccatttctatgtatattttcccaaaataaataaaaacacatgcccacaaaatcacttgtacatgaatgttcatggtctgtttagtcctaatagttgcaaaattaaaacagcatgaaatccaccaacagatgaatgataaacatgttgtggtatatccatacaatggaaggactgcaaactgtatgacttcgcttatgtgaagttttggaataggcaaaaaaatgaatctgtagttataggaataagataagcaattgcctgagttcagggccactttttggggtgatagaaatattctatatcacaattggtgtggctgttaatggatgatgacacttgtctgaacttatcaaactagacacttaaaagtagtacattttgccgtatttcagttatatctttaaaaagttctttttctttttttttttttttgagaagtagtttcactcttgtcacccaggctggagtgcactgacgtgatattggctcactgcaatctctgcctcctgggttcaagtgattctcctgcctcagcctcctgagtagctgggactacagatgcctgcctccacaccaggctaagttttgtatttttagtagagacggggtttcactggccaggctggtctgaaactcctgacctcaggtgatttgcccgcctcggcctcccaaagtgctgggattacaggcatgaaccactgtgactggccgataaagttgatttttaaaaatgataaaagattcagttttgactgtgaacaagttacctcaaaaacaaggctattgtttttctaatctctatatgcagtttctactaataaatgtttctaatgttttaagaaataacagatatgatttggatttctttgaaagagattgagcaggggagtaatgtgatctggtttgtatttgtttaatagattttattttttagagcagttttaggttcacagcaaaatggagacgaaggtatgaaggtatcacatatacctcctacccccacaaatgcagtctcccccgttctcaacatcccccaacagaatggtccatttgttacaaccactgaacctacattgacacatcattatcccctgaagtttatagcttttattagggtgcacttctggtgttgtacattttatgggtttggacacatgtataatcacatgtctgatttgcattttcaaatggtctattttaatgatgaataaatgtgatgtggtttctagaaaagaaaaaaagggggatggatttttgcccagacacctggatgtttggcttttcttgaacaactgggacatctgaggacgttgttgtatggtggtcatctggagctgagcagttgccacccctctagatggagccagcactctctccagctcacaacggtcaacactcacctgcttccctctttatgttacttgatgataccctgtgaccattacccgtgatgagttcaggtatagggcgatagcgtttttttttttttttttttttgagacaaagcttcattcttgtctcccaggctggagagcaatggcgggatctcagctcactgcacccctgcctcccgggttcaagcgattctcctgcctcagcctcccgagtagctgagattacaggcgcacgccacaatgcctggctaattcttgtatttttagtagagatgcggtttcaccatattggccaggctggtcatgaactcctgacctcaggtgatccacctgcctcagcctcccaaagtgctcggattataggtgtgagtcaccacgcctggccccgattgtgtcttaaacaccttcccagagttccctaggccttggggcagctagatgttaggcatgcacccaagggtaatagggaagatgcaaaggaaaaagcactgtgtatgacacctgtaatcccagcattttgggaggccaaggcaggaagattgcttgagcccaggagttcaagaccagcctgggcaacatagtgagaccctatctctacaaaaaataaaaaattagccaggtgtggtggtgcacacctgtagtcccagctacttgggaggctgaggcagaattgcttgagcccaggaggtcaagcctgcagggagttgtgatcctgctactgcattcctgccagggtgacaaagcgagaccttgtcaaaaaaaaaaaaaaaaaaaaaaaaaagccagattctaagtggatttgggcaggaaaagagcataatgcaatagttaactattcaagcttacagtaaaaaaacagcagggaacaattgctaagataacttccttcccaactcccaccctgccacccaccattaaaggtaagacatggtgtaaggggcacaaaacctaaatgactgttcttaagtttctgccataccactgatgagagaaaaaagcatttttaaaacagcttcatttcttaaacacctgcatttgtagatgagattcctgcctgctacactgctatttctgaaatcacattgatgtcagccactaattccacctaaacatagagcttaggctgggtggaaaagtgaaattgtaccttttctgccaactaatagtcatcagagtatgtttcagtttacataaatttttccataccttgggattgtaacttgactttccaatcttctcatttggtgctattcctacttgttaatattggagacttgtactgtatctatatgcaaaggctagaatttaaaaatcatgcaactgcccagtgggttcatcctgtccactgcctagataaagccaatttatcaagacaggggaattgcaatcgagaaaaagtttaatacacgtagagctgtttaaaatgcagactgggccagccaccctccctgtccgggagggaggtggggggcagcccccgcccggccagcctccccgtccgggagggaggtggggggtgcctctgcccggccgccccttctgggaagtgaggagcccctctgcccggccgccaccccgtctgggaggtgtacccaacagctcatttagaatgggccacgatgacgatggcagttttgtcgaatagaaaagggggaaatgtggggaaaagatagagaaatcagattgttgctgtgtctgtgtagaaagaagtagacataggagactccattttgttctgtactaagaaaaattcttctgccttgggatgctgttgatctatgaccttacccccaacccggtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggtaggccgcagggtcctctgcctaggaaaaccagagacctttgttcacttgtttatctgctgaccttccctccactattgtcctatgaccctgccaaatccccctatgcgagaatcacccaagaatgatcaataaaaaataaaaataaataaaaataaaataaaataaaataaaatgaagactggggttttattattactcagatcagcctccctgaaaatctagatgctagggtttttcaaggatagtttggtgggcagggggctggggttaggggcaatgctgattgtttggggttgcaatcctagaggtgtggaaaatggccgttctgtgccggctgcttctgggtggggtccacagagaagtcgctggaccgggtgggaccatctggtcttcagaaatgcaaaagcttgaaaagatatctcaaaaggcaaatcttaggttctacagtagtgacgttatttacaggagtagttggagaagttacaaatcttgtgacctctggaacaatggctggtaattggttaattatgtctacatcttagcagaattcaggcccctctcacactgctaacctggtggcttttcattagttttacaaaggtggtttagttttgggaatggctattagcatttaaaccataactcaatttctcccaaagctagcttggcctaagctcaggaatgaccaagggcagtttggaggttaaaggcaagatggagttggttagatcagatctttttcactgtcataattttctcactgttacgaattttgcagaggcagtttaaatttcttcttcttcttcttcttcttcttcttcttcttcttcttcttcttcttcttcttcttcttcttcttcttcctcttcctcttcttcttcttcctcttcctcttcttcttatttttgagatggagtcttgctctgttccccaggctggagtgcaatggtgggatcttggctcactgaaacctccgcctctcggattcaaccgattcttctgcctcagcctcctgagtagctgggattataggtgcgcactaccacgccggctaatttttgtattttttgtagagatggggtttcaccatgttggccaggctggtctcaaactcctgacctcaggtgatctgcccgccttgggctcccaaagtgctgggattacagacataagccaacgcatctggccttcaatttcttgacactgataatgtttcttaatcaattgtctgcttgttttcaggtgatggctttgtaatccctactttggattttttaaaccaatgttttattaaagcttaatgagttctacaagatgtacaataaagatcagcaatctaccctatctgaaagacaatctgtaaaaaacaaaacaaaacagaaaacaacaacaacaaaaaaccccaaaaagctccagtaattatttattttggcatttacttgtaaataccaaaattcataccagtgagaatattataacagtaaaaaacatctgatttaaccaactccatcttgcttttttttttttttttttttttgagatggagtctcgctctgccaccaggctggaatgcagtggcacgatcttggctcactgcaacctccgcctcccaggttcaagtgattctcctgcctcagcctcccaagtagctgggattacaggcgccttccaccacgcccagctaatttttgtatttttagtagagatggggtttcactatattggccatgttggccaggctggtctcaaactcctgacttcaggttatctgcctgcctcaacctcacgaagtgctggaattatgggcgtgagccatcatgccaggccatatatatatttacccagctcctattcaagatggagttgctctgattcaaacgtctctgacaccaccttggcctctcaaagtgctcggattacaggcatgagccaccacatccagcctacttgtatatttttaaatagaatgcttatgctgttgtttctcaatttttcacttttattattgactcctaactatggaaaatgaagacagattatacctccctcactccaccccccattcacttctcaatatagctatataataaatattcagtgttttattattaaagctgtgtaaagattattattcatagctgggtcacaatatatactgggattatattccaatccacttctcttttttttttttgagatggagtttccctcttgtcacccaggctggagtgcaatggcgtgatcttggctcactgcaacctccgcctcccaggttcaagtaattctcctgcctcagccttccaagtagctgggattacaggtgcctgccaccttgcccagctaatttttgtatatatttgatagaaatggggtttcaccatgttgaccaggccggtctcgaactcctgacctcaggtgatccactcgcctcggccttccaaagtgttgggattaaaggtgtgagccaccacacactgcctccatttcttatataacattattttccctggatttaatttgcttccctgactttgtcttttgtgcagctttcctgtgaacatatccagtgctgtatcagggccatcttttttgagacctctctcctagagcctggagcttttgctccaatctggacttgctgccttctaggcctgatgtgcacctgccattttggaatctcccttcaccatctttctttttcctgaactaacttactttctctctctctctctctctctctctctctctctctctctctctctctctttctgtctctctctcaggctggagtgcagtggtgtgatcatagctcactgcagccttgaactcctgggctcaagccattctcccacctctgcttcccaaatatctgcaactacaggcacatgtcaccacacctagctaattaacaaaaatctgttttgtagaaacggggtctcactatgttgaccaggctggtctttaactcttggcctcaaataatcctcccgcctcaacctctaatagtgctagaattacaggtgtgagccaatgtgcccgtccctgcatttgttttctaattttgtccttattccactttcttagagaattttttaaaacttttcttctactgaatttcctttaaaattttatcatggaaatttccagacatatacaaaagtagagaaaataacataattaaaatctttagcaccaggtacccatcatccagcttcagcaatgatcaacccatggccaatcccagacttcaaatcttcatctgtaaatccttcagcatgcacctgccaaagataaagactctaaaaaacccagaataccattttcatgcctaaagctatttgcaacaattcctattctgttgcactttcacttcctctgtttaagagaaaattttaagtgttcgctttctccccgtgtgttttccttttttttttttttttgagatggagtctcactctgccacccaggctggaatgcaatggtgctatctctgctagctgcagcctccacttcccgggttcaagtgattctcctgccccagcctcccgagtagctgggactacaggcatgcaccatgcctggctaatttttgtatttttagtagagatggggtttcaccatgttggccaggctggtttcgaactcctgacctcaggtgatccttccacttcggcctcccaaagtgttgggattacaggtgtgagccaatgtacccagcttttttccttttgtaaaatggcatgttattcttgtttgtatggatacaatattttcttttatttgtaaaaatcaaaatagagttttcattaacttttctttttcctgcatcatttttcttgttaatcagttgtattttcctgtttgtgctcctctcttaggggctggagattttgtccaggtagctgatgatccttggctgcccgcccgtatttcaccatggagcactcaaatgccatttggagtctctgtgctcatgaatgaggctcctgaaagcgaaggctcctctgactctcagtgtcttaaggtgcttcctacaagcacagatttggacagatttctcccaaaagaatctttttatctcttgcctggctacaaaactgaggaacacatggaacaaggaggccttgcagatgctttggtactctcctgcccattacttcagtttccaggatgtccccatcccaatcaggagtccttctgggtcacattcttcaggaagtaaactggtcagggagtagcttgactgtacaaggtgtgtgtgggggggaggggagggttcttaacattatgctgtatgtcctagtgcactaatttttttttttttgagatagggtctcactttgttgtccagtctcgatggcagtggcaggatcatggctcactgcagcctcaacctcgcaggctcaagcaattcttccacttcagcctcccaagtagctgggactacaggtgcacaccaccacacccagccaatttatgtatttttttgtttcaagacagggtctggctctgttgcacaggctggagtgtagtagcacaatctcagctcactgcatccttcacctcctgggctcaagcaattctcccatctcagcctctcgacttgctggaactacaggcatgcatgaccatgcccagactatgtgttttttatagagatggggttttgccatgttgcccaggctgttcttgaacttctgggctcaagcaatctgcccacctcagcctcccaagttctgggattacaggcgtgagccaccacacctggccactagtgcattgattaacacaagacagagatatacaagcaaaagaattagcatggaagcaattacattgtcattaacttcagataacatggttgtttatgcagaaaactaagaggaatctatgacctaccagaactagtaaggaaatttagcaatttcactggatagaggatcgtaataaattaactgtattttataccagcagtaaataattcaaaaattgaatttaaaaagggaaactattaaatatgtgaacacatacctgtagaaagatctctaaacatatgcactatactatgcttatgttggaaaacaatactgtaaagatgtaaattgttctcaaactaatcttaagattcaatgcattcccaatacaaacttcagaagatgtttttttgttgggggtgagatgacagttgaccggttaacagtaaattcacatgaaaatgcaaagggttaaaaatagctatgacaatcttgaagaaaaagaagtttggaggactaatgctcttaaacaatgagacatattataaagctatagttactaagacagtgtggtattgtcaaaaggatagaaaacagccagtgcaacaggagagagattccagaaacagctttctatgcaggtcacttaacctgtgatgaaggagacactgctgcctgttgggttacatgctgttcatggtcttttcataagtggcacaagatcaattaaatattccatataccaaaattaactccaggaggtctctagatcttaacattaaaaggtaaagtaataaagtgactagcagatcagaatctatcttcatgatatcagaacaggcaaagatttcttaaacaagtcataagaaacagtaactgtaggctgggcgtggtggctcacacctgtaaccccagtactttgggaggcaaaggtgagtggatcatgaggtcaggagatggagaccatcctgactaacatggtgaaaccctgtctctactaaaaatacaaaaattagctgggtatggtggtgtgcccccgtagacccagctacttgggaggctgaggcaggagaatcacttgaacctgggaagtagaggttgcagtgagccgagatcgcaccactgccctccaccatggcaacagagcaagactccatctcaaaaaaaaaaaaaaaagaaaaagaaaaaagaaacagttactgtaaagaaaaaggtagacaacttggattacattaaaatgaggaacttgtacttagaaaaagagattattaaaagaatgaaaagacaagctacacagtaggataatatatttacaatacatataactgaatccagaatatacaaagaacacttacaaataaaaagaaaaagacagcaaatggaaaaggacttgaacaggcacttcacaaatgaagatattcagatttgaaataagcaaaggaaaacatgttcaatctcatcaggtatcaagaagatacaatgagagacacaatattatttcctccacctgaatgattaatattaaaaaaatcatactacctagtgttaatgaggatgtgggggaactggaactcttgtgccccactggggttgttgtaaacagaatgtccctgaagcccagtgtaaccataccctatgacccagcaattccaccccagccatatgcccgacagaactctctacacatgtccacaaaaggacttatgcacaaattttcttaaagcattattcttagtagacacaaactggaaataattcaaatgtccacaagccacagaatggataaatagtattcatttgtgacacagaatattacataatgatgaaaatgaacaaacaacttctatgtggagaagcatccatgaatctcactaacataacattaaatgaagaagccagacacaaaactcagctctgctgttggacgtcaggattgtgattacttctgggggtatagtgactgggagggggcattatggtggtttctggagtgatggtaatgtgatattttctgttctgggtggtgttacctggaggagggggcattatggtggtttctggagtgatggtaatatgatattttctgttctgggtgtgttacctggaggtattcacttatgatgtatgcttttccttatatatgttgaatttcacttttaaaatttcattaataaaaacatgagtgtgcattattcaaggctttgctggtgacattaaactgtgtgactctccaagggatgtggaactgctttattttactatctaaataaaataggcaggctccagaacctgttgtttgatctaactaacagccttgacatcagccaaggagctcacgctggggattctgaagcggaacagtcagcgttcagaccaacagccatggcatggattcaggggcccactggggcctaatttgaggcagattctgtacaaaactccacttaacacctgattactgatatagctcagctctgactagtgaaccactgttggctcctgcggtccccagaaatcagtgtcagctcagaagcagcatcccagaaccctcctaactttgtggctagttcccctgcccttatacaaagttactcaaccaatatccacagtttcctttggaggaaatttaagagaacgagtcataattctcttgcattattaaaacagagagtctttttaagtgtacctaactgctcctttatttaaatacttcttggttggcaaattcaataatttctgggaactaagcgattggtcatgactcctaggatagctcataacaggtctctattgatcagaaataaatgttgtggctgttatacaaatcaaggaagaccatatggatgggctgatgtggtcggctgttcctggttccccgcactcagtgtcccttcctatggaatcattgtatgtccccaccctatagacctctgactttctttggccagtgaaaaatgtagcctcctgactttctttggccaatgaaaaatgagagaagttgacacatgtcactgctggggaggccccataagagccagtgcaggggctgccatgctgtccttcctgcctgtgtgattgttgaagtatgtgtgaagatggaacccctgttagcctggatccctgagtgactacctggagcagctaatgatggaaatggaatgtgtgtcagaagaggttgtaagccacgatgatttcaagctgttgctgcaatgtaatctagccacaaaatgcaaaactggagatgcaagcatgaaaataaacaagaaaaaagccagctctcaataggtaaggaaaactaaccagggcggatcctgccagcatccaagcataacagtgagataaatctgacacagctgactccgtcttgctccttacctcacaagctaactgctttttctcattcccgcatgtaggctgagctaactatgagaggagtttagtttatagtttgaagcaagaatgataacaggctatattagtccattttcatactgctatgaagaaatacccaagactgggcaatttataaagaaaaagaggtttaatggactcacagttccacatgtctggggaggcctcacaatcagggtggaaggtggaggaggagcaaaggcacgtcttgatgttgtcaggcaagagagcgtgtgcaggagaactgccctttataaaaccatagtatctcatgagacttattcactgtcacgagaacagcatgtgaaagaccctccccatgattcaattacctcccacgacatgtggggatcatgggagatacaattcaagatgagatttgggtggggacacagccaaaccataatatagtcccttcccaaaactaacccctgaggagataaggaggctatacatacaaatagcaatgttctgttaaaaatgtataggagtgtattagagcaggtagtaaggcagtcacgagcagggcagaagaggcccccacacccaagaatgtcaggcaaccattaggtgatggtcatttggttaagctgtctctctttaaaatggtaattggtagcagctgccaacagggagagacggtcttcaatagatagaaaacacctggagctggtgatcagcagcttccctaaagaatctcaggagttggaggagcaggctcaagcatgtgaactgaggcaaaatggcggagcttaaccagtatatgaccttcctctaggaaatctcaactggtaagggaagaatgccccaagcgagcatgtgcatgactttagtaaacacactgcacatgcggcccctcccaagtgctggcagaccactgtgcatgcagacagcccaccccaagggaagaatcgcgggagaagagacacaaacctcagaaccacaccagtgtataaaaacccaaatcaagggctgaacagggcacttggatctctcaagtcacccacttggccctcttccaagtgtactttactttctttcattcctgccctataatttttttaataaacgttcattcctgctctaaaacttgctttggtctctccctctgccttaaacatacttctgcctcttggccgctttcctccaaggaggcaaggattgagtttgctgcagacctgtatggattcgctgctggtaaggtgcattgtgacctgaccaaagacaaattttgcaactctcttgggctcctgctgacacccaggtgtgtgtggtcaccagtcatctcctgacctcaacctcctacttgttccctcttccccaatataaaaagaagcttgagattcctgcctgttaagatggttctttaggaccttcatctgccatcttctcagcttgctccctctccaacataaagtcccttcccttgcccccagcaccttgtctcttgacttgctgtcatgcagggcatggtatgagctttggactcaactacacaagcagtacttgagagactggcctaaataaaatacagcatttcttccatactcaaactttcaagattcaaagtcaccggaaagagcatctaatttgtcaaacttaatggtttgaaacaacaactgcaatatgtctgtgtgtgtgtatcttttacacctttctctctgcttacacagatatgtaaaacataaagattttggctcccttttacttacaaaaatatacaactaattccccagttaatacaatgatgaagtccagaatattccacctaaaaatatgactgtaggagaccagaatgtgccaccccaaacatgcctattatgcatacagattatatggagctgatcattttgagtagcagcagtcccaggagaaactggaaagcagaatagaagtgacggttttgtaagagatatttgggccgggtgcagtggctcacgcctgtaatccccgcactttgggaggccaaggcaggtggatcacaaggtcaggagttcaagaccagcctggccaagatggtgaaacccagtctctaacaaaaatgcaaaaattaggccaggagcagtggctcatgtctgtaatcccagcactttgggaggctgaggtgggcggatcacgaggtcaggagatcgagaccatcctggctaacacggtgaaaccctgtctctactaaaaatacaaaaatttagctgggcatggtggcgggcacctttagtcccagctactcaggaggctgaggcaggagaatggcgtgagcccgggaggcggagtttgcagtgagctgagattgcgccactgcactccagtctgggcaacagagcaaggctccatctcagaaaaaaaaaaaaaaaaaaaagagatgtttgtgtctgcaaaggaaacttccagttgtaagagtgtcttcctcactgcgctaggaagagaaggatgactaaatcaccagggacttttttattaattgaaaaggcaccactttaaataagcagaacaaacctatcccttgtttaaggtgccttttctagccagagtgctttaactgggcttcccttctgtccactgcaactttctttttttgtttcagagaacaaaaaaagggtatttaaatcttaagtcaatgccccttctttgagatctatagatgctccttgacatatatatgatggtgttacctcccagtaaacccatcgtaaactgaaaatatcataagtccaaaatgcatctaatgcacctaacctaccaacatcatagctcagcctctcctaccttaaacctgctcagaacacttgcatcagcctacagctggacaaaagcatctaacacaaagcctatttacactaaagtgttggatatactttgtgatttattgaaagtaaaaaacagaatgatttcacagcattgacagcatcatgaggtcagaaattttttttttttttttttttttgagatggagtctcgctctgtcccccaggctggagagcaatggcacgatctcagctcactgcaaacttcgcctcccgggttcaactgattctcctgcttcagcttcccgagtagctgggattataggcacccaccactacacccagctaatttttgtattattagtagagacagggtttcaccatattggacaggctgctctcaaactcctgacctcaggtgatccacctgcctcggccttccaaagtgctgggattataggcgtgagccaccgcacctggccaaggtcagaaaattttcagtcaaaccatcataagttgaggaccatcagtagaggtttactaatttctttgggtatttcccatgtgtataggagggatatatattattaaacttctgtttgtttttcttttgttaatctgtgttgtgttacgtggagtctcagctaagaatgcatgaagggtgaaagagaaaattatttttcttcccatataatatcatggcatgtcaccaaatcaatatggatatatttaaatttaaaaataattataggctgggtgtggtggctcacacctgtaatcccagcactttgggaggccaaggtgggtggatcatttgaggtcaggagtttgagaccagcctggccaacatggtgaaaccccacctctactaaaaatacaaaaattagctggggatggtggcacgtgcctgtagtcccagctactcgagaggctgaggcatgagaatggcttgaacccaggaggtggaggtcgcagtgagccaagatggtgccattgcactccagcctgggtgacagagcaagactctgtctcaaaataaacaaaagaaaaaaaaataattattgcaaattccacaacatggctttgccatacttcattgaaccagaacgtgaacgctcaccaacagggctgattaggttttgccaccacaaacaccgcgataaacatttttttttgcactgcaataagaactggtgcttttatttctataagatagaattcctgttattcctgtcttctttcctatttctctcttctggagtggaaaagtctgtcctatgcctgtcccaccatggaattttggaagcacgtaacttgtttgatttttcagattcgcagctggagaggaattttacctcaatatgaattctaccttgagactaccacattttttttctttttcttttttttttttttttttgaggtggagtctcactctgtcgcccaggctggtgggcagtggcatgatcttggcttaccgcaagctccgcctcctgggttcacaccattctcttgcctcggcctcccgagtagctgggactacaggtgcccaccaccacgcacggctaattttttttttttttttgtatttttagtacagacggggtttcaccgtgttagccaggatggtcgcaatctcctgacctcatgatccacccgtctcagcctcccaaagtgctgggattacaggcgtgagccactgcgcccggctagactaccgtattttatttaggtgataattagatgagactttggactttaaaccttaaagttgatgctggaaatcaatgtattttgcatgtgagaacaacatgaattttggggtgctatgggcagaatggtatggtctgagtctttgtgtctccccaaaattcatatgttgccatcctaacccccaaggtgatggtactggggggtagttagatcatgacagtggagcccataggaatgggattaatgcccttggaagagaggctccagagatctctactgccacgtaatgacagagcaacaaggcatcagctataaataaggaaacaggttctcaccagacactgaatgttctggcaccttaatctcgagcttcacagccttcagaactgtaagaaataaatttctgtctttataagccactttgtctatggtatgttactatagcaacccaaatggactgagaaacatacatacgtacatatgcaagtgtgtgtgagagtgagagaaaggtagggtagcaaaatgtttgcaataggtgagttatgacattcacattctcattttattatttcaatgtttcgagaagcttgaaaatttttcttttttatttctttttcattttttttttttgtttgagatggagtttcactcttgttgcccaggctggagtaccatggcgtgatctcggctcactgcaacctccgccctccccgggttcaagtgattctcctgcctcagcctccctggtagctggggttacaggcacatgcccccacacctggctaatttttgtatttttagtagagatggggtttcaccatgttgaccaggctggtctcgaactcctggcctcaggtgatctgcctgccttggcctcccaaattattctcatatttttaaataagtggtttcaaaataatcatgaatccctcatttggctaaaggtaattattgctggagggggtcatgaatctgaatgagaccactttaaactggacaatactgagctgcatttattgctgaagtttttattgaagtataatatataaagcagaacataatgataaggcatggtatataataaagtgcacaaatcattaagtgtacagctcaaagaattttcacagggagaatgtacccgtgtaaccagcaggaaatagaacctcacctgcctccttttctggtcactgtttccccaacaggataaaaaatgttatcctgtcctgatttctgatactttagggtcattttcctgttattgaattaatacaaatggaatcacataataggttgtatttcgtgtctggcatcctctgatcaaaatgatgtctgtgcgatccatccatattgctgccaggtgtggcctctctgtccacactgctataacacagccttccatggagtaaaggcagctcggtggtttatctatgttgctactgatgggcacttaggcagttttcagttttttcttattacaaatatgtgattctaaatagttccatatatgccatttggtgaatggatgtatacatttctgtaggatatagatccagcagtggaattgctgggttgtaggatatgcacacctctggttctgacagatgctgccagttttccaaagtggttgtactgcttcacaccgccatgggggttctattgccagtcttttccattttagccattctggcagataaatagtgagattgcactgtaattttgatttgcatctccttgattcatggggttgagggctttgccgtatatttatgcgtgcgtcacatatgaagtgtttactgtattttcgctcattttaaaaagtatattttttttctaataacttcctggcatggagacaggggcctgtctttccttgattaacctgactttctccctgggggttctggtctagcaactgctgctgaagttttcagtccctgtcaccttctgggtgtcacatttctgagggattcaggaagcattttcacctgaatcttttattcccctaaaattttctctacctggcatcagagcctctatttcatttttgtatctggttcaaatgtctttgccttgatccatagtattttctcctttttacaattgattccagtgtagaactagcagggaaaacatcaagcacttggaatttaaagtttgagatgtcatattctacatagtaatgccattgctttcattttttttttttctgagacggagtcttgccctgtcccccaggctggagtgcagtggtgcaatctgggctcactgcaacctccacctcctgggttcaagtgagtctcctgcctcagcctcccgagaagctgggattgcaggttcatgccaccacacccagctaatttttttatttttttgtatttttagtagagacagggtttcacggtgttagccaggatggtctcaatctcctgacttcatgatctacccgccttgtcctcccaaagtgctgggattacaggaatgagccaccgcacccggccctgctttcatttatatagattgatttttctgggtgaagcacaccaaattctataaaagaactatggaaacctcaaatacttttccagtaaaaaatgcatttttgaaatgataatacataatcatttcaaatacatgagaaatacagtatcatgagaaatacattagttctgatgactctggagacattgaatctaaatactccacaattcaatttctcaagcattttatgtatatttgcatggagtacacacacacacacacacacacacacacacacacacacacgatggtaccaccaagcccctacactagccctaggtctcctgtccccaggcttcttgttatgtgagattatcttgttttggagtcactgctcacccgctattcttgcagccaacagcattcgtggttaaaaatgactgcaaaataatacatagagcagcagatggttgatgcatacatacattcagagcatatacagcactcacttagttatgccattacattatttttctgagtgactgagcttaaccttggagaaatctcataattctcaggggtggaatatgaggccttgacccattctcatggtttcactccatttttattcagatgagcattagtcactgcttcatgggcctcaaagaatgtactttgcttcctcctggaagatctagataaaagggacagttaggggcaaaaatcagaaagttactattgtcctaatacttgtgatgaatgagaggatgggagtcttgcaggacagtgaaaagatgggataagctcaaatgagacaaaaggttagaaagttagatacagacgcaatgtctttctttggctcaagagtcagaattcagttatttattgatgaaggggcgatgatgttcctatttgggatgaggatgagaaatgaaaatgaacatgtaaaagtcatcagaggaaggcatgatttaggtgttgagaaatactctgctaggtagaagtcttagctatcctcttgcctatgtgggggctaaatgttggtggggcgacactatgtatggtagccatggcccaagtcagtgtttcttttcttccttagtttaattagtctttcaaaccaattccaaagagcaaccacaagttgggcctgcacttggcgggtgtagcatatgctggtttttgctgcctgaggaggctgttcttgccttctggttatggctaggtcttcaggtcttcagatagctcttcccaagttggtgatggccactcaaagttgtcacacacagtcagcatcagggctgtggttcccgccagtgagcctggctgggggaagcttggtgatagtgaggtcaaccatgttcatggcactgacgatggaagagacccaagagattattttggaaaatggttttcaattagcttaagaacaagatcttatgtagaactcctatatagacagacaaaaactaaaatgctcttgttgctggcgagagtgctcgcttgaagcctgttctgctcagaatctccacatctggacactagggaccctcagaaaacaatctgaaacatacttttggagtccaactttgctgtgtagagatggttaaacttggggcctcttggataaggagccaactcgcccaaagcagtgctcctggctccaacattttccacgcctggctgcctaatgtctggtatggaagtgcaccagtgaagcctaggttgagagttgaactgggacaccaaggcagcaaaggatgccaggaatgtcaggtgagaattaaacggacattctcatgggaaagccaaggtgtgagcctgggaaggaacatttactagacagagactgcggttagggcaaaagtgaagtcttgagtctggggaagatttaaaatgaagcagttgagaaacagtccaggcagtcagcatcagggaagtcttgtgagtctggatgactgcttttaatatctgtggtgttagaagctcaacctgtagaagagcctacaggttgtgctgtcagggatcagggtgccttaaagaactaggcagatatcacccccttgcatgtgtgatatgagcatgcagatggccagctccttagcatatgattggggtcttagcatgaatggactccatgaaacccacccccactattggaaaatgtggctaaagtgtagacatcactaatcattggcgagtcatattatgtattcctttaaagaagagttttggccgggcgcagtggctcatgcctgtaatcccagcaccttgggagggccaggcgggcagatcacaaggtcaggaggtcgagaccatcctggctaacacggtgaaaccccgtcactactaaaaatacaaaaaattagctgggtgtggtggcgagcgcctgtagtcccagctactcaggagcctgaggcaggaggatggcgggaacccgggaggcagagcttgcagtgagctgagatcatgccactgcactccagcctgggcaacagagcgagactctgtctcaaaacaaaaaaaaaaaaaaaaaaaaaaacagaagttttgcattgaggaaaatcacagcaccttgagaacaaagcaatatcaacctcattagaaggaacaggggagcagagttcattgtgcttttgtcagtttcttaggacactatgatgagattttgctccattcaggccatgatgcctattcctgtccacaggagcatttgatccttacccccacgctgcgactccgaggcagggcggacacaattgtcccgttttataagtgagaggagagcatttagcagtggtcacagagctaatctgtcaggatcaggactggaatccaggctgcagggttgatgctccgtccacgcgtcagtgctgacttcctgaggaatcagcaccgtggctacaatgcggagagcagaagtagacaagtcatccaggcaggggttggaaaactcagctcatagttgcgtcctctcagttgagtggagatgactcatgacattaatacggcaatcctctaaccattccctacagagcttggcctcttaaagagtaacgtgtgctttggagttaagctgtgctcatctagagctcttattgaaccatgattaatcactctttccacattcacaacctacgggatctgaacttgacccatttttaaagccattcaccctgcctggactccatgcatattttcactgcaccagtctgctgcttttcctcccacccatcactatcatgtcacgccatccgtcagttgcctccctctagctgccagtccccattccccaccaacatgctacttcttcttcttcttttgtttttttgtttgtttgtttgttttcggtttttgttttttttgaggcagggtctcactctgtcgtccaggctagagtgcagtgcagtgctgctatcacggctcactgcagcctcggcctccccggggctcaggggatcctcccacctcagcctcttgagtggctgagactacaggtgcacaccacaatgcccggctaatttctgtattttttatagagatggggttttgccatgttgcccaggctggtctcaaacttctgcactgaaatgatctgcccatctcagcctcccaaagtactgggattacaggcataagccactgcgccaggcactacttccaacctgagaagtgagttgagcaactgttggaaatctggcccaaggagacttggagtaagagtccaaagagtcagctttcttcctgatcccggcgatgtttctggtgtcaccccttctgaataagtcacttgctgagttactatttactggacacacccgtctcagaaaatacaggtcactccaaagcactctgtggcttacatttgtaattgtggattttgctttgaaacttcaagggtataaagatatttgattcactctgatttccaactttgattttaagttctggggtacatgtgcaggatgtgcaggttagttacataggtaaacgtgtgccatggtggtttgctacacagatcatccaatcacctgggtattaagcccagtatccattagctcttcttcctcatactctccctcctcccacgccctaccctctgacaggctccagtgtgagttgttccccccatgggtctgtgtgttctcattactcagaatcggtgatgtgtcttggtagtactgagtctagtcttaggacaatgctgtcttctgggctgtggaaggagagaattttgcccagattcgtggtcatgtcacatggagctttgtccccatcaggactgtttctgttcactttcccaggggcacagcgtgtgtgttatatatgcctgaaccttgttcaagggagaagatgataagaattaatgagaacaagtctccatggactacatgaccctgttcatttgaatcttttatctaaaaagttttcatgtgttgacaccaaatatattaaagtatattttaattaaaaaatgtttttgaaggaagagatatggaaaagagaattactaagtaaagaacagaatgggtcctagatataatcacaatatctgcgcttagaagaaccagaggctttctgtccactggagcccagggccaaatgtcacttcctaatgtctgtagtctttcacaaaccagcaacttttccaaaaattaagagaacaaatatgaaaataggttatgagtcttgcccctgagtatgtgtcatctgaagggaaccatatgtgatggtgatgagtatgtgaaattgtgttatgccagtcgatttagttttatgtgtgtttgaaattttccaaaatagataagtaaaaaaaaaaaatcagaaatgcattgttaacagaaacatccttgaaaagttttttttttttttttttttttttttttgagatagggtcctgctctgttacccaggctggagtgcagcggtgtgatcttggctcaccacaacctctgcctcccagggtcaattgatcctcccacctctgcctgctgagtagctgggtctacagacacgcatcaccatgcctagttaatttttgtgtgtgtatattttttgtagatacaaggtttcagcacattgcctaggctagttttgaactcctgggctcaagcattccactggtctccgcccaaagtgtgagattacaagtgtgagccactgcacccagcccatccttggaatagttggaagctgttgtatgtatgatagagaggatgaaagaaaaacgacacattgaattgggctcctgctttgaatggaaataatggggtcccagagaggaaacaactgtcagagacatggttgacaagatttatgtaataggctctagggaaagagaaaatcaaagcattttgatctcagggtcccaggaggtagcttgtcaattatggaaccttaggaatagaatgtatgggcaatcgaataaggcgttaactttaataataataataaaaacgtttctgggtctggtgggcagaaattagactcaagttaccacagctgagtttttgtttttgatggagttttgcccttctcgcccaggctggagtgcaatggcatgatctcgactcagtgcaacctctacctcccccattcaagagattctcctgcctcagcctcccaagtagctgggactacaggagcacgccaccatgcctggctaatttttgtatttttgatagagacggggtttcaccatgttggccaggctggtctcaaactcctgatctcaggtgatccacccacctcagcctcccaaagtgctgggattacaggcgtgagccactgtgcccagcctacagctgagtttcaaagcccctcactggacctgctcccagtcctggggcctcttgattgaagagaaggctgggcccctttggggaaattccccacaacgtggccatacctgcaaactacacacctcccttcaaatgtctgcagggagacccctggccccttaccagtgtgcaagggaaatgcacacccctgtaggacattttaggcactggctgtggggaagttcccgttctctggggtccggttctgacctcagctgcggctcagcaggacagtttcatgcaccccacagcatggcattccgcactctctccaccctcctgcctcagggcttgcttcgcaaccatgaggactgaggacttagcctgcactcagaagcctcccagaagcagggtggtgaggctgacgccttgggagcaaacatcaaccaatggggtgtaggagtcagcgggtgagtgttgtggcctcttgcccttcagggatagactttagggggagtacaccctgcttgtccacagtggacaccagctgtccagtgtcttttttttttttttttttttttttttttgagatggagtctcactctgtcacccaggctggagtgcagtgacatgatcttggctcactgcaacctccacctcccaggttcaagtgattctcctgcatcagcctcccaagtagctgagactataggcacctgccaccacacctagctaatttttgtatgtttagtagagacagggtttcactatgttgaccaggctggtctcgaactcctgaccttgtgatccacccgcctcggcctcccaaagtgctgggattacaagcatgagccactgcacttggccttctccagtgtctttttattggctcctccttcctcacacccactctctctgcttccctgctcctgctttcagagatcacctcccaaacaaactacttatacccaatgttctgtctcataatttgcttggggcagggtgactcaattaagaaactgtatctgcactaacgtggatctctggggcctcctcctaccaccatgtctaccagtcagagtggggattatggaggttggaatcttggcccaagtccatcctgctacaggcccagtgagcacacggactcaaatcgtggctgctcccgtcccgttactgactgcttagaataaagatgcttaatcagctgcagaatatccacatcagctcactcatctgcgaagtaaaaattggtgtggaaaagaagggccaagtaaaatccttgaaactgctccctgtagcacccctgtaatcccgagggaattatggagattagaatgcaaggggtcagttcctgaggaatcactatttaaattatctgcttggctggcatcagagatgagtgtcttgggtaatcaatgtggattatggtgattgcagctgtggtcccagatgccatatttctggtggagtaaataaacataaaccctggaacctggtatgcagtaatcaagttgacaaaaacaaacaaacaaacaaacagaaacaacccactttgaccttcattttcttatgtcacgattttgtcaattcttctgccctccatattatatcgtcttgaaggaacttgacatcccaaataataccagatggtcgttatattgataacgtgattctaactgcacccgctgaggaggaattagcaaatacaacagaaatcccaataaaatatatgcctgctagaagacgggacataagccccaagagatgtttctggaaggacatctagtagcatggggtatattagaatatcccctctaaagtgaaaggataccaccttgaagaaagtggtacaatgctcgtcctggaatcggggctacatttctctagcccattttccagataactgttgcaccgggctcctattaatttcaataggaatggcaccaagttcaagaggccaaagatgagacccagagccagcaaatgagagttgcggttactgaggggaacttacatacagggtggcccatggttgcaggcagggaggagaactgctgccgcccacagaaagcatgcagtttacaggacattttcacaacaccctctgtgaaccccccaatggctgagatggtctcagttaacttagaaagttctttttgccaaggttgagtatgcctgcccgtgacacagcctcaggaggtcctgatgacatgtgcccaaggtggccagggcacagcttggttttatatattttaggaagatgtgagacatcaatcaatatatgtaagaagtacaatggttctgtccagaaaggtggggacaactcgaagcagggagggggcttccgggtcacaggtaggtgggagacaaatggttgcattcttttgagtttctgataagccattccaaaggagggcaatcagatatgcatctatctcagtgagcagagggatgactttggatagaatgggaggcaggtttgccctgagaagttcccagcttgacttttccctttagcttagtgatttttgggccccaagattttcctttcacatctccacctggaaaccttcatttaacccaaaacaagggggcctgaacccctgagttgcctgagttctgtgggacaggtcaggcgctcagatattcctcatagccaaggaacgaatctccagattgtcctcgctcaccactctgaatacacattcaggtgcatctgccatacggggtcattcttaggatctgcttaagttactttattgctatcaggtgcatcaaccctaagtaactaataaggctgccagtattaagggaaggagagagtaacagagagctcttcagtaagtccaaattgcagtgaaagtaacctaactaatcattgcaaatagggtggatcgatcagaagccagaatcatcaaggtggcatgcacagaagcattcaattattaaacagaaatagcatgggagactgggcactgagcacatcagaatgctcagcaattgctatgggcagatggcccaggcccccctgctgcctgcttctatcactcacagcctctccctccactcacacccgttgcctcatggcgtttccactattgatcagttaatagaaaaaaaggtgcagcctcttcactgcggagtctgtggcatgtgttggcacctgctggcagaggaccattgctgccttaaggccccaattaggtgtgattctgaaacacaggaatcaatgaccatcttcccatgggacaaaatttccagaagtaaatctctttgctggctttgcctgaaagaaaaggtaggctgaggcatggacccacaatagcttcaggggcctgattgcatgagcaggtagcccaaaccccctcgttgcccaccacagttccaccagagccactgccccagttcctactacagccttgttggagctcccatatgatcagtgaaggaggaggagaaacctgagcttggctgatgattcacttggctcattatatgggtgcaaatgcatgacagctgtgttacagccacattcagggatgcccttgaaagactgcagatagaggaacttttcccaatggttgaagttatttaagcagggcatctggcgtattgtaagacctaaaagttcaaatgctgccttgacacctttgggcctccatggctccaaggtctaaacttctaggtcctcttctctcccaagatactcacaatctccacccccttgtgggatagactcctacccaggtagttctcccatcaggtgggtgggctgcatcccacctggccctcaacctaatgggttccaccttccagcaaactgttggaattactcaaacaggctgttcacattctcctgtaatgagccaccacaataccctctttatcaactcgcccaccccctgtcactacaaagcctgcttccccctcccccgaccagtgcactctgctcccaagtgcggcctcactcccacggtcctcctccctgggctgagtctatgtgactgagaaactgccattgatcatacctgtccagggccaggtgtcacgtgttctgccatcttatactgttttgggcagggtatcccttcctcatcaatggggtgaagtagaggcaaccaaagaacctagtaatccacggcttgtggcctgatgtgagggtgtggattggtggtctctggtcacggggctggaaggaaaaggactccgcttcctggtcctcattgtacatagcaacaggcaggtgctgctggctggggcaggtatgattcccaagggtccagacccctcaggaactgaggctcaatggacaccatcaggtaacctgctaaggtgagagctgagggtgaggggaatttagaaagctttaatgacactgggtgatcctgggcccactaatcctcaacatgtgtgggcattctgcttttgattgtattcagccacttaaggagatggctgtgggtctctctgggaaaggactaggggaattgtgatggcatatactagacatgatattgcagggtccttcctgctagaacccagcctcctctttagtcagtgggttcttgatctggaaattggtctcagtctgtaagggattgtgtcttttaggtttctttgatttgggttgaagtcaaagcagcaccctggctgctgacctgcttattttggccttgggggtaccatactctcttagtcctcccccatatcccaggagtcaagcacccttgggcacacctcgttggcattatggtcactgtgagcttctagcttctggtgaccaagtgtttctgcctggcccctgtcacttgacacaacatcgtctgcatggatatttgcgtgtgatccgcctcttaccatcattcctggcctccgaggagatctaccactgagcttttcactagttcattcttgatggcctcagtgaagggggcttcctctgggccccccaggaacataatcctctgaatcttccagccttacataatctatctgtcccagaagcccacttccctcagccttttattccttcctctcccatctgccaaggcagctcaggatttccacaactaattacccatcactttccccaggctgctgatagccacactggtggtgagtgccccacctcatggtgtccttgctggttctgtgtcctgagagagtgcccccaaatctacaagttcttccttatttaggattatttattttattttatttttccacaggttattggggtgcaggtggtgtttggttacataagtaagttctttagtagtgatttgtgagattttggtgcaccaattgcccaggcaatatacgctgcatcctatttgtagtcttttatcccttaccgcatcccactgttccctccaagtccccaaagtccattgtatcattcttacgcctctgcatcctggtagcttagctcccacatattagtgagaacatacgatgtttggttttccattcctgagttacctcacttaaagtaatggtctccaggccaggagtggtggctcatgcctgcaatcccagcactttgggaggctgagatgggaggatcacctgagattaggagttcgaaaccagcctggccaaaatggtgaaaccgtgtctctactaaaaatacaaaaattagccgggcgtggtggcaggtgcctgtaatcccagctatttgggaggctgaggcaggagaatcgcttgaacctgggaagcggagggtgcagtgagccgagatcacaccattgcactcccacctgggcaacaggagcaaaactccctctcaaacaaacaaagaaacaaacaaccaaaaaaaaaaaaaaaaaaagaatagtctccaatctcatccaagtcgctgagaatgccattaattcattcctttttatgggtgagtagtattttatcaggtatatatacaccactgtttctttatccactcgttgattgatgggcatttgggttggttccacaattttgcacttgtgaattgtgctgccataaacatgtcctgagagagtgctcccaaatctaaaagttcttccttattcagttttatatctgctccagcagatgacatttgtcaatctccctcaaaatctagtccctggggccctcccctcattcttgctggaatcttgtagacattccttgcaaacccttcagttatagacattttccaccttatgaggcctagccaggtaatgctacaacttaaccctgggttctttcctgaagccaggagaaggggagggaggagggcctgagggagtggctgctgcctgggggtggagtggggtagaggcacctgccacagcttccagactggagaaagagctagggaaggggtgggggcgacttctgcaagctctgggcttcagggtgtcctcaaggaccggcgttcttttctttgcaagaaagagctgtatgtaaaaatgtatttctctgtatggctttccctcaacagtatactcagccatttgagtattggggccatcctccaaaaagccagatggttctagtaactgaagacagatttgacctcacaaaatgccaaactcgttcttgctttcaccccactgccaaagaggaggaaatgcctattataaaagcagctttctgaaacacgcctggtaaactgtggatgcagcttactggcctggttaaaaagaggcaggagaaaaagggccttggttattccccagccctctccccacgtgtttctgttttctttcactttaattcagatacctgaggaatgctaggggcaaaagcaaaccaagaataactgtggtttgtgcactcagtctatgtgtaaaagatacttggctattaacaagaaatgttacacatcccactgttagacacttcccaagataataatttaatgttatgaatatgactctttgaagattcatgtttagcctcttacatcgtgggacatttctaagttgagacaaataagaaagtagagacaaataatttctattctagaataagatacttcaagtaatcttatctcaataatttactcactttaggctagtgagtaactttatccaataaataggtacagtcatgtgtcacttaacaatagagatatgttctgagaaatgcactgttatgtgattttgttgttgtgcaaacatcatagagtttatttatacaaatctgtatgggataacctactacaccttaggctgcatgggatagcctattgctcctatgccatgaagctatacaatgttactacttacatcagcattacagctgagtaacatgttgtgctattatgactcattaggtgataggaatttttttagctccatcatgatcttatgggactatcattgtgtatgtggtctgttgttgactgaaacgttattttgtggcacatgcattttgattttcttcttcagaagatgagctctcctaggctacatattttgtgttcgtctaagcatttggacttgctgaatactgcaataggtgttcattgtgtttacaattgagacctcaaccgatccttcaggggctttgagcaggagttgcctatcagaactgtcccagattggcaagggagctgggactctgtatccctgcatcagtctgtcattggcttcaggtcacctgctgggatgagacaacactgagacaacatcggcaaggctgttttatgcagcagagctcaattcccaatgagggacatagctataagccatcaacagctgatactcagaatctagggaaggaagaatcggtgcagagggagggacctggacaaattaccatagcatccactgcagtccactccttatacctccaagcccacttgcttctcacagtgagttctttccatccagggttctggttgttgggacaaggcacgaccctcactgttgcagctggtctcaagtctgtgacagatactcatcatctcccttctccactagctgcctgtgttttcttgcacctgtgctagcatctctgttgaccttgatgtcagaatcatccatgaggtaaggccctcatcccggagggatctgacccactggttaccaagatcttttcatgccatgattgccacatctatgtatttacattctggagaataacatgtccatgctaatcactttgctgccaaacacatctgacacggtttggctgtgtctctacccaaatctcatcttgaattgtagctcccataatccccacatgttgtggaagggagccagtgggaagtgattggatcatgggggaggtttctcccatgctgttcctgtgacagtgagtgagtctcgcaagatttgatggttttataagcatctggcattttccctgctggcacttctctctcctgccgccttgtgatgaaggttgtgtttgctttcccttctgccatgattatgcatttcctgaggcctctgcaggcatgtggaactgtgaatcaattaagcctattttctttataaattaccagtttaggtatttcttcatagcaacgtgagaatggactaatgcagtatccttctctgctccctccgtagccacaacctgccacctcctcataatcagttacccctatcacgttgctgactcttgtccttgcctgctagtctcttggcatgagcagcccaaagtgaacaagttacattgaactattgctatggcacctgatgggagctctgtctctctaggaaccagaacctctagactcacagagcctaaagtcgcatggacaagaaggacaacgttgccaggtggtcactgatgtgacaggaagcatgacgatgtgcttctatttcatgatttccaggcctgtccgtatagtctaccttaaggacagccccataaaaagacattgattgatggtatcgctatctatagagggatggtgttgcagagtagagtctcctagtagtatctccctagcacatttgagaggccatcccccctctccatcaggctggcagtttctgggtaaaatagtgtcttaatttcctagggtggctgttaacaatgtgccacaaactgtggggcttaaaacaacagaaatcaattttcccacagtgtggaagctacaaatctgaaatcaaggtgtcagcagatagggctatgctccctgagggctccagggaagagtccttccttgcctctcttgttcctggtgttgctggcaatcctcagtgttcgttggcgtgtggtggcatcactcggctctgtcttcacatggccttttctctctgtgtctgtgtcttcacacatccctctcttatgaggtcactgtcattggatttagggcccacattaatccagtgcaattttaacttgattacattagccaagaccctatttccaaagaaggtcacattcacggataccaggggtgaggacttcaacacttcttttttctcaatcggggagaagtgcagctcgacttgcaacaagtggtctgtgatgggacccgaggccatgtgctcattgctgtaaagtggggccattggttcacaaggatgctaaatgcaatcctgtatcagaggatggaaacttacaaaggtccttggacagtgacctggctgagaccctgcaggcaggagaggcaaatccatccctgctgatgaatagccgctcttcaaggtggctggtgatccccttccagtgctctatgctgcagtgtatgctttctggaggatgttaaaagtgataaaaacatatccacactttgtccttattccctgtggttcatctacaagcctctttcacagacatccttccttccagtcattcaccttccagacctttagccactgttcatgagtctgtatcatcttctttcaggctgctcccctttccaaacaaaatggaagatcaagtgcagcacctagagctctgccccttggaagggtctcccctgactgctgtctcccaaggccacccagagtagacatgagacagcagcagtcttcttgctgacttgcaccaacacatcaggctgacccacctgtgaattccccttggccctgctggtgccgcatcagctggacatgtggccagggctttgagctgaggggtaggtgcttgtacagtgatgacagacagcagggtggtctgggccacctcttgtggagctggcttgcaccctccagctctgctctgcaccacttctgttttatgctgttttgctgctgagcccacccaatcttgtaggtgggtctgcaaaattccacatcttgatggttatattttgttccagtgtcacttaatgtctcatgctcagatgctctatttctgccagagccctggctcacacaaactgcttttccaacagtgtaatgtttcctgttgtagacggagtgactttcctccagaaccctcagggtctatactgtgactcttttactggtgtttatcataaaatcctcatggagttttttcccattacaggtactcctagtaacataagctttgcaaatcataaagcccaagcagttgggctgctttcactgcagccaggacttctgctagagccatttcctgctcttagccccaaccgaacctggcagcctttccacatcaccaggatgtgaatcagagcagctgcctctggcattcaaagtgctgaccaagtattaggtttcctttccagcgggggaggtaccagatgcaatacgtatatttttataatgaaaggaataccctgttacactccaggccactgaagccctaacatcatcaatgacgttgttggggtccgattcttcaaagacaaaattatttctcacatcttggagcacacgtattttacagaggactctaacaaacttgagacttcttttcttgcttgtcttgtcttattgacatcccacatcaacacagtggagcagcgtgatgttctgatgacagcagttttcaaacactgtggtctcaggaccccttcatattctttaaaattgagtaccccaaagagcttttgtttacatgggttatatatattaatatttactggaaaataaactagagacattttcaacatatttgtgtatttgtttattaaaaataaaataaacccattacatgtctatataagtgatacctcattatgaaaaataattatttttcataaaatatttctgaatagcattaacatttttgcaaatctcttcaagacagctagaacatcatatgtttctacattccatctgttgggatatgttattttagtttaagattgtgaagaacatccactttcatacagatatacagcagacaatagagtactttaatactattttcagataattatggatattttttctgtgatgctatattaaaactcaatgagtggtagcaccttaaagatttgttgtgatgtggaatctgaaattgtatcatgcatgtttattatgctgttacattaaaattcgttggtcttggccgggtgtggtggcttaggcctgtaattccaacaatttgggaggctgatggggatggatcaattgaggtcaggagttcgagaccagcctggacaacatggtaaaatccccatctctactacaaatacaaaaaacttagctgggaatcgcttgaacccggaagatggaagttgcagtgagccaagattgtgccactgcactccagcctggatgacagagtgagactctgtctcaaaaaacagaagcaaaaacaaaccaaaaaatcagctcctacttgaatgaaatagattcataccttcccattatagaaaaatctaaaataagtatttttctataagccagtgacatgacttgattacaaaccgtaagtaacctcaatagacaactgagtctgcactcgaatgattgctagatggctgcaaactaccttttggaaaggttttagtagatgtcccatgatttgtttatatgtctataattccctcttctccagtatagcacctcgttcagttatgtggttgtatcttttgctagtatcttttgtcggatggtatattagcttgctagggctgccataacaaaataccacagactgagtggctcatactagaaatttattttttcctagttctggcagctggaaatccaatcttgatatcttctaatcttccaatactggtatcttctaatgtctctctccttggcttgtagatggccaccttcttgctttattctcacgtggtctatcctatgcacacacacatccttggtgtctctttgcatgtctaaatttcctcttttcataaggatgtcagtcagattgaatgaggccctatcctatggcctcattttaacttaatcatccctttaaagatcttatttctaaatatagtcacactatgaggttctaggggttaggacttccatatataaatctggcagggggtaagggaggggggaaggagagacacagtttaacccataagaggtgacaacccaggaaggtatatttcccaatactgccatttcagaggtaccatatggcagacgggagttttataccttttcagattcttttccttttcagtgtttttcaagataaaattggggctatgctttaagatgaagctgaaatattatgattttttatttgtgtatttttaagagataagccagactttctgaacagggtttgtcccttctggaaatgctccattggatctctcctttgtgggaatattctattcagtccctaaatttatgacactctatttttcacaaattatcctcagtcatccttggctttgtccttattaactattctgctgctcacttagctatcaatacagacagctgtggcctggggaatcagtagggaatataatcacaagcccataatgcctttcaagattcatagagatccattgaggcccgcctgtgggcaacacagttcatccattcctccagataacaggccctgagactagatgcagaactttttccaaagaagaggattcatagtttacatctcattcccattagttccatgacctcaagaaggtgatttgccttaaagaagcacaagcttgcttccagattggggccatgcacagttgctctgcatgcaggcagtcaccatcagctgtttttaagtggtgtttgaaacagccctgtgaataatccggtatttaatgatgttgtcccgtcctctaggttccagtggaggactttctcttttctcagtgcattctcctgatacttgttttactctgcaagaaacaaaatcttatatgaaaacatgttgctaatctttaaatagttaaaactttctgactaaatttacttgtaaatgcacaggatttcacgacactcattttatatacttaaaaacaaagcttattaacaccttacttttttcctgccatttctgtccatcatttttaaaatttcaacttcttttatattgctatatcatgtgcctctttatgaggtgctttcaatcataatttctggttagaagcttctgatattttctcagtttctgtggatgtgtttgtggttgttttgtgtgcatgtgtgaggggagagttaaattacctctttcttttgagtgagatggagctcttataataacttgtatcccaatttttccttctcaggaagcaaatttagtagggaccactggagactacccatctgccttatgactctgaggagataaagcattcttcagccattcctgttggagccaggtgaagcattctagctccaacacctcaaccatctctaggaacagcagcaactgctatctcgcctctcctcctttaaggaaaacaacccttaagggaagcaactgagagctgggtaagaagaaagcaatcacgtgctaaaatcttccggagaacaaaagttagtgaaactatcttagacccctaattcagaactcttgcaggaagagtaaatacttatggaaagctgagaaagcagtgtctagggcctccagtccacccctagagggacgtgtgggggtggctaggggaacgttttgaggaaagttcattggtcaacttgttcaacgtggcaaactcatttcaggcaagagaggcagcaccgtggacagcgccaaccctcctgctcccgggcggggcgaggtggcagcaccgcggacagcaccacatgtggtggcgcacactgggagccgccaggcgcggggagcgcagcagcaccgcggacagccccaaagccgcgcgctctgagccaggaggcggggagagatggccttatcagctgatggcttacgtagggctagatctccacttggataaggcaggtctcggtgggcgcgccagcattcgctctccggagctgcagcctccgaaggggtggcgggggcaacagggacagaaggcaggtcccagaaagcaggttcccccaaaactggcttccctagcacggagttaaggctgcagccggctgcctagagagaagggtgggcagggagacaacgcggtgagagcgactgctctgacgcaccagcccctctcctgcacccacacgctgctggccgcccagcttctccccgatctgggagatgctcggctctgggcggccaaacagcctttccaccaaggcgaggagccctgggctcctgacagcttaggcgggccctggctgcgacacgcagcccctcgcctctgcttccttagcctctgagggcttcagacctgccgcgcttgcagccacaccatctccaacggatgctcactagcaggaaattggggccaaattcacaggcactttccagaaactcccccactggccagaggttgcaaacatccggattggctctgggcacagtggccgccttaagtcctcctgaacaccccttctgcaagtaccccagggcggtctcctgacccagagatggatttacctgtgaacctaacctccttttccctctccaccccctcccctttggagaccaaccacagcctcggcaaagacgacctgcgccccagctcgcccctgctctcggtcttcggagtgcttattctcaccttgctgggctttctggtggcggcgacgttcgcctggaacctgctggtgctggcgaccatcctccgtgtacgcaccttccaccgcgtgccccacaacctggtggcatccatggccgtctcggatgtcctggtggccgcgctggtcatgccgctgagcctggtgcacgagctgtccgggcgccgctggcagctaggtcggaggctgtgccagctttggatcgcgtgcgacgtgctttgctgcacggccagcatctggaacgtgacggccatagccctggaccgctactggtccatcacgcgccacatggaatacacgctccgcacccgcaagtgcgtctccaacgtcatgatcgcgctcacctgggcactctccgctgtcatctctctggccccgctgctttttggctggggagagacgtactctgagggcagcgaggagtgccaggtaagccgcgagccttcctacgccgtgttctccaccgtaggcgccttctacctgccgctctgtgtggtgctcttcgtgtactggaagatctacaaggctgccaagttccgcgtgggctccaggaagaccaatagcgtctcacccatatccgaagctgtggaggtgggtatctcagcaatccttaaaaatactcgacttgcatctgtacaggctatatccccaggccacctgccccacccccacacttgtagaaaatggaactttttgtgtttgggagtggggggagtaaactgggagagtggaagaaagcatcagagatgtactttgctctgacatgttccctctcacagggctaatcatatcatgttccttctctaatgggttgtttgttaaatatacagaacacgaggagttcagactgcgtcattctgcagggtcccctttggcccccaaattctatggatctataacaccctttagaacatctgaataagctggtatctggggtacgctgattcagtacactggaaaaaactagcagcttccagcacttagaatgggggtgttccaggaggaggggaggcagggatgggagcatgatttgataagaagactgccatgagtcaggtgatgcaggttagcatttcatcctagtctattctttttctttgcaaattacagcagccggtttattaaaaatatggtatcacctaggttactgtcattctgtggcatcctcccgtcctgacgtaagactgaagatgttgactgcactagtcccggagcctgcatttgttatctgcttccactgccttagggtgttactttatgggtctatcccccacagccctattaggttgtaggtgtgactgaggaccacttgtctgccttcctgaacatgagtaaagctgcggaaggaaattaaaaatccaggaaagagaattccctagctctctatgagaggtatttactgcatgacaaccactatagcaacagcgagggagcttttctcatcttctcccactcctgtttttttgttaactcttaataatctgaccctacgactcatgattctgcaggctgctcccccttcattaccaaggaagattccttgaatctaattcacacatttaggttagaccagaagtctacacagtccccattttctgttgttggctctgaaacaagaaagtagtttaaggaagcatatggagtgcatactatgggtttggtgcaagaggtaagcgaatgatagagatgttgtctttgcccatgaagagtgtggtctagggagggaaatagacatccaccctgagctctgtatatgctttctagagtcagtagctaactctaaccatccccagtcagtcaaacttagagggaccagaggtgtagctagggaaaaaggggagagggcatcatcctagaggaaagaagaaaacgaggggtcagaggctacctgttcttttacctatatcagcatttctcagcgaagggtaatactgccctccaggaaacatttgggctgtctggagacattttggatgattaagaattgagggccaggtgcggtggctcacgcctgtaatcccagcactttgggaggccgaggcgggcagatcacaaggtcaggagatcgagaccattctggctaacatggtgaaaccccgtctctactaaatatacaaaaaaattagccaggcgtggtggcaggcgcctgtagtcccagctactcgggaggctgaggcaggagaacggagtgaacccgggaggcggagctggcagctagccgagattgcgccactgcactccagcctgggcgacagagtgagactctgtctcaagaaaaaaaaaaaaaagaattgaggatggggtgttaatggcatgtagtatagagaggtcagaaatgctgctaaatattgcacaatgcacaggacagcccctcaacagagaattgttcagaccaaaatgtcaatcgtactgaatttgggtaactctgatctattagatttctaagctgaacaaagagtgctgatgggtaagaacactgaagcttccatcaaactacctgaagtgaggttccatgtgtatgagggtccactcaaattccagaccaggaacaagaagactggtcacctccaagggccctccttttatgaatcttcctctcccctgatgtttattcaggcaaatataatttacagtcagccctaaacacagctttagaaggagaaagttaattacaattccatcccaaggcttcctgtaaaaggatgaagggcactctcatttctctgctttggtgatagcagaagcaaagcattataacatctttgtgctttttatatagatacacacacacatatatatacatatgtgtgtgtgtgtatatatatatgtatatatatatgtatatatatatatatatatatatatatgtatatatatatactctcttctctctctacttttcccagatcagttttttaaatgggccccttggcttagcaaaaggacccaaaataatccagtactctaaatataatatggggctgcctctgtccttatgttatgttgaagggttaattacaaaccaggcctcctgattgttctgtgataatgggagtgggtgtcaaagtttctaaatgagttctaccactagctagctgttccctggggaaaccacaacacttctctcttgtttctttatctgctgagttttattcaaatacatgccatgaaatcctaacctaggtcagacattgagctgggatctggcaacacaagatagataagacttgcccttgtcaaaggaagaggaagccactgctagagatctgaaataaaatgacaaagaaaaatgccttccttactagagtgagcgggggctgtgctgtctaggcacagtttgcctaagaagagcagaatgctgacctgaaactgcgcttttgggaggtatggagcctcacggattggtggatttttgagatgtgggtagatgacaccctctgtatgagaagctattgctgattggttgttcctccaatgcgtatttactgaaatgagtccatctctggtggcctgactttcagaactgaggggctaacaccaataatctacacaggtactatagacatccaggaggtagagacagtgtgaactattttaccttctattattctaaccctaattgccctcccatccttattcattctatatataattaacaaaattaataatcctctgactctcaaaattataggctaccaatgatactgaagctattcatatatttgattcctgtatgatccttgcagcgacctacacctagaagagaaacctatgcaaaaagactctatacatgtagacaaacaacagcaaaagcaaagcaagcatcagtaggatacgtagatgaatagcatgacaccatttgccaaacagtacaccttcatgtcaagaggtttgaagccttttacacagatctaagacaattccctaatggtaggtctcttaatcaaagatctagttacttgacacaaacacctcagccttgtgaccttatatgagaacatacttggttacaaatcctaagagaagaaaattttaaaatatattgattgagatgagttgcccttgatcagtagactaagtctaaaacttgttccgggctaaagagcactcagtcttttcctaagtgcgtgggaacattttcttctcagtctgtctgtgttggtcctcattcagccaaagctgcaggagagatctccgtgattatccagattgtcaccactgtttttggtcctcttaatgatgaagtttcatctgtggagatgtgatgttcacattgcacgttgatcaacatgagtttatgctattttttagatcatctgttgaatcatctgtcaggacagagctctgcagaagcatgtaaagttccgaacaacagatgctgaaggactaccagataaacaagaataattataaatattgtaagaagagactggaaaatctcccaagttcttcttcttagttccagtgccttcttagtcaattctttgttgaggagctgtccttgacccaagacttcccagctttgatcaggaaagcaagtcccaaaagtttcttgtgtatctgttaggtagctatgttcctttttcttctagcttaaatatagattgttttgcctctgtcttaatccaggtacaacaagaaatggtagctatagggtaaactcttccatgactggccacaaggaaactgaaggctattctattcatcatgactatttgggttaattgttgtggcctgggagcttaggctatataatattttatgtcagctaatgcaggcattatttactatgacaactttaaaaaaaaaccctctagttatccaactgtttaaatggggtcattatcttcaggagccttctctgagagagttttgtccctttggactcttcataaggaggtatagtccattgagggcattggcgagccagattttggaatggcctaacctatggccctatggagcaattaacttttcttctcagttgacattgagacacttaacgtcagcataggataaaggacccaggaactatagaagagaggtgatcaatcttagtgaagctgtaggtacgttatctgtaagtattgccaagatggtcactaattcacatggtcatctgtttgtcccgaggttcttggtttaatggcaatgtccacacttctctttctggaggttccctggaggacctcagtttagaatggtttggggtagcatcaagtcatcaaataattcacatttgttgtccatttttagagtacctgaaggagatgtttctatagtatgttaaattagtgaattattctggaggtatactaattattagtctacatacattctgtttcatttttttaacttaatatggacctactggaaaggtccataatttaagcattgaacaacttggctttgggtaagaaattaaattttatgggagagactggactacttattatatatcaaacatggtattgttatttttgttttttagcataccatcaacaaacaatatttcattggaatttggtactagaggatccaagttctgtctggagccaggacactttaattatagaaatgcagttatgggattccccttccttgtctaagggtttcctagctgcggggtgatgcatgttacaccaggagaaggagaaagtaaccatgaaccattatcaatcaatgagtagaaaaatattggatagtttctgttagcaattggggcttattacatgtggtatataagatttaaaggcctaataccaaatgttctgaagatgtgttgactagttgaattgatgcctgtaatttctctgagacaagaaggcaaagcctccaggttactgaactaagcggtgaacttaaaataagcaatgttctttgacaggtgctatgctgtcaccttaatccacccagagcatggccccatattttcatattcgcatgaaaaggaatgttcatgataacctaggaagaatcattcttaactcttatgcattctacttcaattaaattttctagttgtggagtctcttgtccatagagattctagaaccatcagtatttctatagtaatttttaaaattacatgcagtgtaggcattctcacgtcagatcaggtataatctcatcatgaacaagggctgcagcacattttatttggaagcagatcctacttattgcaggtatgtcatagattaaagaagtattcttttgataatgatctgaaaatatcagttataagttggcacacagaattgttaaagattgttactacttgaattcttccattaagtaaagttgattttctctcaagcctttgaaaaatttactatatagccagaaatttgtcaatttgtcattcattatcttgtttcactatctggtataacctataaccaataggttttttttttgtttttttttttttttgagacagagtctcacactgttgtctaggccagagtgcagtggcataatctcagctcactgcaatctccacctcccaggttcaaatcattctcctgcctcagcctcccaagtagctgggattataggtgtgtgccaccatgcctggctaatttttgtatttttagtacagacaggggtttcaccatgttggccaggctggtcccgaactcctgacctcaggtgatctgcccacctcagcctcccaaagtgctgagattacaggtgtgagccactgtgcccagccaccaatagctttattgaattttttgtttgtttttaatttttaaaaacttgctacaattttcttttttgcttttcagacaactttaaaaatgtacatggaatgatctgttgttctgtaatagtggggttactggtagttatattgacacccacataaacaaaaacattatatagttgtatatctagttacagaaaattctccttggaagtttaaaaagacaaagaaattgttgagtgacaataacttccttggagtggctttattagatagattgtatatagttgtcattttgctttttggccaacacgagatgttcattctttcaagggtcctcctgctagcaatatattaatatatacagggatccttatctcagctctcaaatctttgagaacagaggcccttttggatgccttatctagaaagccatatcttgtattgatttatagcatttactttctaagcctatctggaaatgtctagccccatattggatattttgcaaattggcaatttcacatttcagtttattttttcttattaaattcccaaattcaggtttaagcccatttatagaaagatatgacaagactatacttcagctgttgggtatacacaaatatgctgcttgaaggttttctgaagtctattttctatctttattcagcctcccgagtagctgggactgcaagtgtgttccatcacacctggctaatttttgtattttttatagaaatagggtctcaccatgttgcccatgatggtctcaaactcccaagctcaagtaatcctcctgccttggcctcccaaagtgctgggattacaggcgtgagccaccatgcccagattcatttagtttactttgaatctttattcaacctctccttaaaagaaagccttctaaaattactttacataatatattttctatttttatatttaaattttcacaactgggttatataactcttctattttctgtgcttctttttttttttaccattttttcttatctaagaggattttagttaatttaactaattagtacacatctatagttcaagaaaataaaaattttgtttgatattctaacaaaattataaattctataacaaaagtttagaaaatttttctttctttttcttcctttcctttcttttccttcctttcctttcttttccttccttcttttcttttctttctttttttgaggcagggtcttgctctgttgcccaggctagagtgcagtggcacaaccgtagctcactgcagccttgaaaccctgggctcatgcagtcctcacacctcagcctctgagtagctgggaccacagggatatgccaccacacctggctaatttttaaaatttttgtggagatggggtctctctattgcacaggctggtctcaaactcttgacctcaaatgattttcccaccttggcctctcaaagggctgggattacaggcatgagcccccatgcctggcctagaaaatttcttaattatagctcttagctttagacaaaggttttaattaaattctataaatctgatttttcttctggtaattttataatgtgattgtgtttttcctgagaaaaccctggttcatttaggaagtcagataaagctgaatagaaaaatacaagatagagatctgcaaagaggataggtttgggaaggttacaaaatctttgagactatcttagttaggattttcttttaaggactcaaaataccaattaaagaggctgacttttagccatttgatgtttgtctcctaatttttctagagcttctcttaaatatcttaactcactaatttttcattcatcagatgtttttcattaagtaaaaaaagtttggcatttgtgaagaaaattgcaagacttaggatcataatgcaattttaaataggaaatagaaattcttaaaaaagaggattgagatttggacataaacaagccgtggcacatgaggaagaggcaactgtggttggtcaacagttcatgcttgtgaatagtgtctcagggtcctggaccaaacagatggagaaggggacacatgattgtccgcacaactatcattaagctggaaaacaacaggacaaagtgatatattttcacaagtcgacaagtcaggaatgccctcatacgagctttgtaggggaccccaagcaaagtttgatcaattgctttttcataaattggtcactggcctaataatggtcttcaaatcattagccctcaggtccagcttgaattagattggaaacttatcaagccaatgccttatagaatagttccttctgtattcaacagaagaaggagttccaggacaaaacaaaaacccatgcaacaagactttgcacatgtagacaacacacaagcaaggcaagaggccataggataagtagattaatggcatgacaatatttgccagatgatacaccttcatggcaagaggtttaaagctttctacatagatctaagacaattacctaatggtagataggtagatctctcaatcaaagatctagttacatgatacaaacacctcagccttgcgaacttatccaaggacatagttggtcacaaatcctaggataacaaaatacattgagcaataagagcccagtgaaactaggcagaactcaaatccttgttgagactgatgtgcttggctgtggacacaaagggcaattgagtttggggcccagtgaatgcacttgtggcccaaggatcccacggagagtcttcaaaatgacttcaatggagcctccagaactgtccaggggcgatgccactactgctcagagtctgagatagaaagacaaagctgaatctttgactcagaatagcgagaggaagctatgcttgtcagcagtctcccagagcagagcggaatgcccatcatccatgattcggggcagtgtggggttcagagactggaggacactcagagtagcagcaggctgacatcagctgcagaacggagtttactcagaatgaggctttctgttggatggggttttctgatggaatggggttttctgttggatggcgttttctgttggaatgggattttctgctggaatggggttttctgttggatgattggtgctcagaagtgtgtttattggggtgagtctgaccttaattggctgactttcagaagtgagggctgacacagattagttggtttacaagtgtatattcccaaactgcatcatccttgattgactgaagaggtttaaacaagaaaaacgtctgcttgttatcagttatagaacaatcagtcttgtcctaagtttgtggagggttttgattcataccctcgtggaggcttccttgatgtgtaaggccatttttagcttaaacatttttattgttccattgagctcctgtgacccatctctcattctgacagtgatgtggtctaacttgcaaatcacctgaaaccacacttccaaggtaagagtctataccttaacttcaatacccattattgaaggtaatccattgactatctaggacattattagacaggcaaagcagagtggttggatgaaataaaagaacataccagatttgtgattaaccagtaaataattatttagcatgcaatcattttggaaggatgaaagctctaacacatatgtacctgtccccaaagaatttgtttattgggggagatgaggctaagtgttcatttagaaaaaaatttatatatgaatcttaaattgtgagctatgtactttatgtgcatttcagagattattaggaaaaattaatttggcttaactattcactttttaaccctatttcctctctttctgtgagtttactaatgatcaggttgaatgtagtaattaatagagcgttattgtccagattcaattaagtgctttattgcaatcatggattagaagagagcaaagagctaaggagtacataagtccaagggccatagagtaagaaaacaattccaccatttgagggcattagaaacctgaaactccacaaacaaccaagaccctcctagcagctggagactctattgtcccaggggtaccattttaaatcagtgtcactctttcttctgtcaagtgagttggcattgaatgcagcaccaaagatggcccagtaaaataatcaacatttcacaaggtaatagaaaaatatgcttttctgaacaacgtggagttctatgactaaactctaaaaaaattctaagccctaagtgtcattgatatcaccagtgtgatcatcaccactgtgaacagtatcttcagtgtgaccagcatctccagtataatcagcatccgtggtgtctccagtgggaccagcatccccattgtgaacagcatctccagcgtgaccagcatccacagtgtgaacgacatccacactgtgaacagcatccatggtgtcaccagtgtggccagcatccacagtgtgaatggcatccatggggtcaccaatgtgaccagcatccacagtgtgaacagcatccatggtgttaccagtgttaccagcatccacagtgtgaatggcatccatggtgtcatcagggtgaccagcattcacagtgtgaacagaatcttcagcgtgaccagcatctccagtgtgaccagcatccccagtgtgaacagcatctctagtatgatcagaatccatggtgtttccagtataaccagcatctccagtgttaccagcatcctttatgtgaccagtgtgataagcctccacagtgtgaccatgtctcaagtatgaccagtgttaccagtgtccccattgtcactcataaaaatgtgccaaggggaaggagactttccagagggttgaagagtccagctagaattcttgttttattgccgtcttgggacaatatggaaaacagcttccctgatattattagggggttgaattctgttaaggaaactggtagctttccctctttcctttatgctgaaaaattaagctaaatatggtttggatttctataaatgaatcccctcaaatgcatttccagatatgccttgataaatcagtaaccaaaggtaactctggtttcatctagaggtacagaaagtgagattttcaatgcttattttatatgtgtttttaaagtttggactattatggaccattggtttcattatttattatcttcttttaaatttaatctagtgtacagacttgatgttatactgttttgcaaataaatgtcagcaaagctcttctacaaatttggtaatttattcatcaactaacattgccttaaccatagtgttcctattttcacctgttattccatgtgatagtaagtcagttcctttcgagtccactttataaatgctgccaagaattagttaagtgggttagattaacctgacaattctttgcctcaaagatcgtatgctctttgagaacaaactgagtaaatattttttaaatgtactagagtcacagtatgctggagaggggaagaatactatttaatgttaatgcagtctcactcaccagagaatgaatgactcagaaactgtcgcacattttgattggatcaattaatttgctaattcagtaaatttatgattgcttcatatttaggctgcctcatcagtagacactcattatatcagttctcccaagagctaaaaataggaccagaagggaggaagagcttcctttcccaggaattccactccttgagagaaggaagtgaactggagagcctgattctgtgggaacctgccctgtggaggccttgggggcaccccacaggagactaaaagactagggtctcagttttacataaatataggggtagaggaagacacagaatagacccagagagaggtgtccttgttactggaccgcctcaaacagtagaatatgctatggggcacagcagtaggagctttatgccagaggaaaagttctaacattatagaggggacttacgtgagcccagaaggttataaagatggtagaaaatgtggtcctaagtgtacaggattttgataggaacttaggacacttttgatgaagtgtgcacctctgccactaagttgtgcatgccatgttgcctgctcgtttctgccactgcctctgttgaacagacagcaatagggagtccatcttcatgatgtcaatttcatcacatctggtcctttcatttctaagaggtaagcaaacacctcagctctgttgcctggtttccatatctgagagcgagtgccacaggccttcaggttcccacacctatccatcgaagactttcccttgagtggatgtgcggaatccaggcctgtcagtgtccaggctcagcctagcaggtagactgaggtggctcctcataaagctcctgcttgtcttttacaggtgaaggactctgccaaacagccccagatggtgttcacggtccgccacgccaccgtcaccttccagccagaaggggacacgtggcgggagcagaaggagcagcgggccgccctcatggtgggcatcctcattggcgtgttcgtgctctgctggatccccttctttctcaccgagctcatcagtcccctctgctcctgtgacatccccgccatctggaaaagcatcttcctgtggcttggctactccaactccttctttaaccccctgatctatacggctttcaacaagaactacaacagcgccttcaagaacttcttttctaggcaacactgagggagaggaccaggattgaaaaaagtttcttcccataattcagtggaattcccagttcatccatttcccatccccacccaacagccatgtggacgggatgaatcctcaccattctccagggtcatcttcagaactgcactggcctcttttccacctcctcagtaggaatatgactcctcatagagttacggtgacatgatgtatctaacttatctactatccctttctctgtgctgacagtcatggtctttgcccgcaaagtgtcctttcctccccaaattcactctggcatggtgatcgacattgtcttaaagaagtcaaggcaaataagaaggaggaggtaaaacaatatgggcaggttgagattgaatagaaaagaatgaacaagtcatgatgtagacctctgagggtaggagaccatagttccaggctttctggcacagtccccatttcaaatattctctgtggtcctagtacatatatcctaatactgatggggtatgacccaagagttgaccacaaaacactgtctccaaatatattaaagtatatagtcctatccatgagagcagggaatcttagctttaaggttttgtttgtggcaaccacacacgaacatacacacacacacacacacaactatgaaagaggcaggtgttctagctagctagtttactccaaaatgcaatccgttgacatgaaacaggcactgagggtaactacttcctttcattttgaagcaacagtttataaacaggaaagtctactggtttcatagaatctgtcagatttgtttatttgctactggtttcacgcgcgtggactatattccagtgtttctagtcaaagacctttatcctcaaatcatgagattagagtaaaacaactgctgtaaggttgagcatttcatgaccaatgactatgaaggcacattcaccaaacacaggcactttaagggcatccttgattaatttgctaattgctattttttgttggtatgtgaattcctgctaggaggccgaggctagtaggcaatgaaaaagacagaacaatggtaaaatgcagccccagtcctctacaaattgacagtataatttatgaggtgaggcagttaagtgatgatgcagcatttggatgatcatgtaaaaccagtgtcattacacaaaacttaaaaaaaaatcctaggcaataaaactgcctgtggtctgctatgtctctgactcttcaaatgcatgaattaaagaatgatataataatctctgaattattgtaattcatgtagtatattgtatataataaattatatcaattaagagttcaaacataggaaatttgtgataatttatatgtggtcttggcttgaagtttagtcttgtctttattgcaaagactagctttatcaaaagaatgtgagcagataaagaaatgttagacacctgtgaagtcacaattaatatgctaaatgcagatctttatgcattcaagcagattcattgagaaatttagtgataagaattgaagaatttatttagaaacgtccttagatttttcatctgtatatatcacttgaagtgctaaacccacaagtatttaaaatacagactcttcacttactcaagttacttttccccattattactcgaaatcagagagaataacaaatgctattgttttctagtgttttgaataagggaagtgtttgaataagggaagggaagtgtttgaaaaaccttattaagtaccccatggcagagaagaaaaattcagacatgaggagtctggagaggtaacactagaatcaagggtaaacgcttaagtctattctacctgaaaatccatgtgaaaacttttaatccataaatcgtgagtgtcttactgtttaaaaaagttcatactcttcagtaaagcgaagcttgaggaagatgtgccacatttttctggtggcttcaaacactccccaactctccaaggattctgtataccccagttggagaacgatgttattataatattaattcaatctccagctgagggttttattaatgttttcataagatggataagcctcattattcttatcactcaatatgtatttaacacctctcaggtgtcacttaaattatacattatatacaacatactccacatacactatctagagcaagaaacattccacataagagaaggaagaagtggcaattaatgaattattttgcttccatttcaatagtaaaagttgtttataccctggtaagaaatgtagacattcattgactttgagtctctactatgcaaatcaaatatttgtgaaacactctcatttatgcttgactgctaatattttatcaggttagaaatttatatgaatcataaacagaagtaattgctcaaaataactaattgtgttcccgtgccagattgcaacaaccacctttattagatggtgcacctagagaaggctggagggtttcctgcaagccctctctgtagggtgactgaggtgaaccaatccaaagccctcctttcagctcttgtagaatatgtcgaacaaaacgcacagttctgccctcctgcctaaagacaaagtacaaaggagataatcctctccttatgagtgatcttagccctcttgaggtcactatcagttttatattttcattgtgcggtagtgaaagacaagtggaagatgtccctgagtctgtattgacatcagaccatattgtagggattaattcttgataaaaaaaaagcttgttatttctctcttcttttcatgaggagcatttttgcttccgtgtttgtctgttggatttgcagttccctgctcacagccaaagaggctgtagagacaacactttgccatatttctattaaagagaaaataaagattgagtccacagctcaagtgctgagtgaaagtgattgccaagcagggatttggttggcatccgggaaaaggggaatgggtggccttctcaaagcctctgtcctgtatcaggaaagagattctcctgctctgggctgctcatgggctgggcactgatggttcactggggccgtctgtggtctgtagctgtctttcctgccttcatgaggcacccctgtcaggacattggtgcccaccgtccccactgtgccgggggtgggggggccagcttcaggaggatgaaggtccagcctggccactgtcagctgattaaatggctctgtcaggactgccagccccaggtagttcttttctagcagtctcgggtgctgtggtccagctgcacccagccttccatcttcctctttctcctcctgaaagggatttgcctttccatcaggtgtatctttcaaactcattatcccttctgtcatggcctcctttgcgatagcttgggttggctgctagctgtgttcattgagatctggctcaaggctccgcaagcaagaggaaggaatcaaggaagatgcaccacaacgtgcagcaaatttaatcagcttccccacaaccaagcaaataatcgtcaatgtttattaagccctgaccccatacagggcactgtgccatgcccttcaaagccacccctatttggtcctaacaataacccttggaggcactatggagatttaacacaaaagtcatttgggtcttgtaaaaattaaattattcatccaagatgaaatggctagaaaattagagccaggatcagaaccctaggacctgactccaaactccagctcttggtcttcgtactttaacacagaaacagcccctaaaggataagaaatgattggcaggagccagatgatggcagggacttaaaacaaccccttcctcccctctggcatctccaccaagtacagcccacatagagctgcaaaagcaccagctttcgcaggacacctttggaacagtgtccttttcctttatgatatttggtgactggaggtcaacctcgtgtggcaccagttcccagaccaaatctgccccagagatcaggaacaacctaaccgtgatctacactgcaccaatcccaggtgacctaacaagcaatccccggtggattagcgatggcagatgggaagtaggggagatgacgactctgcccactggtgcaaataaggggagggtctgagattaatgtacagtcgcaggacgcataaccatgaggatgtgctgagaaatgcatcattaggcaatttcgacattatgcaaacgtcgcagagtgcacttacacacatctagaggggacagcccgctatacatgtgaggctgttcggtgtagcctcgtggtcctaggctgcacacctgtgaaggctgttactgtactgaatgctgtaggcagctgtaacacgatggtaatgggtttgtgtatctaaacatatctaaatgtagaaaaggtacagtaaaaaatgattgaaaatggtgcacctgtacagggtacttgccatgaatggagcttgctgcagtggaagtagctccaggtgaatcagcgagggagtgagtggagagtgaatgtgaggacctaggacacctaggacattcctgtacactaccgcagactttgtaaacaatgttcactaaggctacactcaacttcttctttctttttttttttttgagacagagtctcgctctgttgcccaggctggagtgcaatggcgtgacctcggctcactgcaacctccaccacctcccaggttcaagcaattctcccacctcagcctgccgagtagctgagactacaggcgcccgccaccatgtccggatttttttttgtatttttagtagacacagggtttcaccgtgttagccaggatggtctcgatctcctgaccttgtgatccgcccacctcggcctctctaagtgctgggattacaggcatgagccaccgtgccctgctgaagggaagcaatttttaaatgaccaatgttaattaccctagtaattagctaggaatgggtgggagctggaattaactagaattaacattcctagtaattaactaggaacgggtgggagctggaattaactacaattaacattcccagtaattaactaggaatgggtgggagctagaatttgggacagaatttgacatttggcaagccccatagttgtgaagatttaaataaaaaaacctctcttggttcttgtgcttagaaccttaaatggaaatacttcaaattaaaatagtaagaattttgataacaaacagatgtcttcctgggggtcatcttgggtatttagaatgacatctacatgtggtaagaataggctgagggggaatggggctttgcatgagaaaaaaaggatgaggaggggatattgagctgaggagaaacacggcagcaaattgaagtgagtctgtaacttgccagccattgagtgcttcatcttggaagcgagtcttccagcctcagtcaaaccttcagatgactgcagccccagctggtgtcttgactacacttgactacatgggagatcccgagtcagaacccaactaagccactcccaaatttctaaatcacagaaactatcagataacgaaggattattgctgttttaatgtaaaacaaactaaatatgaaactcgaatctaatactaaaaagagaggataaattcaatacaaaagaaaggatatagaattccattttgctatattctgtttcatgcaaactagatatggatttatataaactgggttaatttaatttaatacacaaatataattcatcaaattataaggcatcactttagtactaaggtagcagatttaaaatacacttctgtttataaaaactcaattcatgtatctggagagcacttggaactctatttgctgagagttttcgccaacatgtgtgatgggtgggagggcaaggcaggaggaactcagcccttggctgcctaccctggatcaggctgctgcctggagcacagacacacaaagcattagtggccacatggaaacagactgcttctctcattccttcctgctccactctttggtgccactcctgctcccctatttggtgccactaacctgggtgtctctccctggttaaaaggaagagagtgtgtgtgtgtgtatacatgcacacacacacacatacacatatacacatatgtatgtatgcatacagaagatttccattaatcaaacattcagtagtaataacaaagctgcaaacaaatcagccaggggtcatcatcaaaatgaggcctaagtggcacagccccgcatgtctcagcctatggcataacaggagctttcctgactcaggagtggaaggtacaactcattacaaggcctttacacatcacctaatgtgaagggccctgcccacagctgctgagaccccggaagccacctaatttgaggcttcctcccccacaactcactgagtgagtcatattttgtgcacagagctatcacctcaggctgtatcccaaaggtttctgttagcaggaaggaagaatatcgagccctctgtgtgcaggtgaacaaactttgagactgtggcatttacagcaacagctgctccagtgatcccatctccaccttcagctcagttggaaactgaacttcgggggttagaagggaagagagtcggtgccccattggtttgttaccttcccaacatgcgacaagtcagtttccacgtagatgaaagaggaggtggtctgatttacaaagacagatgagcccccagcttcctgtttggccaccgacgggctcactgtcacctcaccgagggtgcctctgtcctgtcccagcaccgttaaggtgcaatgggtccttggtctaggagtgaagacgatgggatgaagatggggggatggagttaaataaaagggcctgactctcacttcgctttcttcatccttcctgctccttaagatagttggatgtttttcccacttggtaaagttattcctacaattggcctacaggaaaaggaagacaggcaaaacaaacaaagcgtaaaaagactcccctggcctggcagcaatgataacccacaccattgacaccagtatgttcccttattattttacaacaaaagggattgccttttgatataaccaaatatggcattttagaatctttttgacagggttcagtttatcttgttgagcttaatttttttttatgtattctagatccaagttaatgtttaattgaggctgagaagggggaagggctagaggaataactctggctgtgccctgtgatgctttgcaagtgcagctggaggaaagtgcctgtcagtgcaaccaaaaccacatttgatagaacaagaataacagcccagctctttgatccatttaaataggaccaacaggtgcatatgagagaactgggtcaatgggttcttagtgtccagaaaatatgctaaaaaaaaacaaaaaccagcttggagatcactctgtgtgtgtgtgtgtgtgtgtgtgtgtgtgtgtgtgtgtgtgtaccctagactctgtgagtttaaaatgaaccaaaaagtagggccagcactgtggctcacgcctgtaatcccagcactttgggaggccaagataggcagataacttgaggtcaggagttcgagaccaacctggccaacatagagaaactctgtccctactaaaaatacaaaaattagccgggcatggtggtgggcacctgtaatcccagctactcagaaggctgaggcgggagaattgcttgaatctgggaggcagaagttgcagtgagctgagatcgtgccactgcacttcagcctgggagacagagtgagactccatctcaaaaaatatgtatataaataaataaataaaatgaaccaaaaggtagaatacacaggagctctcattacagcagagtagcttcagcccctgtcacacaacatcatcagcttatggtcactaacatcataacgttctctccgtttctggatttctgtattcccctccactcggctgtttgcctattcatgcacaattatgacactttaaaaaaataccaacagaggctttagagttttttatgatacttagttgatctttgtgttagtcaggtgctacggtttgaatatttgggtccctccaaaattcatactttgaaaactaataacccaggtgatattgccaggaagtggggtctttgggcaatgaggtcacgagggtgcagccctcatgagtgaaatttgtgtcctgataatacaggcttcagtgaattgccaggcccttttgcctttccatctcttctaccaccatgtttgtctcttttgcccctttgccttctgccatgtgagaacagagcgttcaaggcgccatcttggaagccaagagcagctctcaccagacactgaatttgctagcaccttgatctcggacttctcagcctctgtaactgtgagaaataagcttctattccttgtaaattactcagtctgagattttgttacagcagcaggaatggataagacttcagtgttcaccaaagaaacagaatcaaaattatacgtatcatattacatatttatgtcttaatatatctatagctatggctatattatctacctacgcatgtatgtatctatctatctacctatctatgagatttattataagagattggcttaaacaactagagagattaagaggttcagctggcaaactggagaacttagagagctgatagtgtaagttccatcttagtctgagactgaagtcacaaaaagaccaatgccccagcttgaagacagtcaggcagaggtgggaactctcctttattccacctttttgttctactgaggcccttaacagtctggatgaggcccagtcacattgaggaaggtgacctgcttcatgtatctacaaatttaaatgttaatttcatcagaaaacatcttcacagacacgtccagaataatgcctaacctgatatgtgggcatcctgtggcccagtcaggtcaacacatgaaattaaacatctcatataatcatcctcattgttcttcatggcatggcttttctaatattgttaaataatattttccaattaaacatcatcagcttgtctagctccaggtacaatactggtggcatttttattgggattgtattaaatgcctcaatgcctaaatcaaactgtaaacttttggatagtcttatccaagaatcagggctgtcttttattagattttaatactctcattctttatcactccctaagccagcttatcttgtctcagctgcctatgaaaaatgagtcaagggtctcaaatgtgcagtcaggctactcacatgtcttgtggtttaggagaacagagagttctaaccgcagtgctcaggtcaaatcttccagcaagcatttatttcctagaacaaagccttctcaaagaacacaggtttccacctcatactggcttctcttaccttaaatcttttccagtagaagcagaagaataaatggaatctaagactgaacgaatccccagctgggtgccaccctggccagccttgcttagaagagcccgagagccaatgaagtcccctatcacgggcagctgtcaatgtaggaactatttctagaggaagttttctccttttgcctgcagtcccagctgctcaggaggctgaggcaggaggattgcttgagcccaggagatggaggctgcagagagctgtgatgtcactactgcactccagcctgcgtgacagagtgagaccctgcctcttttccctcagagtttgttttgctatacccagaactttcctgacggggttagtgtcactgagattttcccttacagctttagggagcattatataattgtacactggctcaggctttcttaggacgacaacagtataagatggactccaggctctctgcaaggcttcttgctccaaaaatgcactgtagaaattgttgcttttgccctaaaaagtcagagacacaaattctatgtagctggaagagaatgaatttctgtgcccagcttgtggcagtttatcacagcagccacaggaaattaatagagacagcgggtgcccttctgctaaatcctgcatcctttcatatcatcaaaaggcaaacagtcattgtttttgtgaactgggcaaggtgttagctctgtaatcctgaggttcgcttctctttgcattagggaactgtggtgttctgagcagagttctttgcacctagtggtttggagaggactcaagctcccgaggcctcagtgccgtctggctgctactatgcgcaagcatgcagtccccatgctcctaccccaacactaggaattttcttctcccatcccccactgcttttaatgatgtgagtagttatggttctgtgggaatgcgagagctatctgaagtattgcgacttcaaataacttcagttcacttacatgaccatggtgaccacattctgaaagatgagtctaagattctgggagcacattcatatgttgttattatgccacctggtgatcttgaaacttctacagatgtggggatggggttgagatcagtgctgatgttggtaagatttactacattaaaccaggtagacttcctgcatagcaagcttgcatgtggactacaggcacagaatgaaacttaacccaaaacaaggtatctagttccgtgactggtatttggagccatcagagtgcttcccctggagcacagcatcctggcctggggttgctcctgctttggccaccttttcaatgtgctcaccggggagccacgggttgggtatcttccttctccatcctgagagtcagaggctgtcatcttgcctcgtggtggtggcacaacctctcccccaacctgcaggtccctgttcctccactgtcgtcttagccactcctgtgccagttttgtcttgtactttactgcctgttgggcaaggcaatgtgccatggtccctgagccacctgcacatgcttgctgaccatgccaggaatgcaagacccttctttctctttgacaaagcatgagcaccgccatcttggacaaacaccactgttctaagttccccttgatttaaaaactgcctaaatccagcccccaaacatcagcctaatggctaatgtcaacataaccagaaacatcccaaccctaagataaactcctctccggccagaaacacgccaaccccgagatgcctccctccgaccagagatattccaacctcgcaatagactttccctcatgtagaaacattctgaacctacgataagctaccaccttccaaaacccttaaatatccttagtctgtaagagagaacggtcctgacctagattggccagaagtccctctcaggtttattctctgaaatcaacctgtctttgactgtcgagccatttttagtttttctttcctctttctttaactcttatgctctttacttgggccatttctcaaggtagcatgtgcagtgaacaaccttgagagaaaagataacactggcccctggacaaggagcaggcttgcttccacttgacacaaaggcagttgattctccaagctcaataatcctctcctctaacccaatctcttgcatgggcagcatccacccaagctcacttgttgctcccgtggaactttaaaacaatctattacccattttattgattttggctgaatgcatataaattatacatttgaattcacattaatctgtaaattaatatgacttttaaacttttctagataatgcaaattaaaaatatcatagtatacattagatacaattttatggataggacacatgcaaattatttatttatttttttagttttttattttttatttttagtatttattgatcattcttgggtgtttctcagagagggggatgtggcagggtcataggataatagtggagagaaggtcagcagataaacacgtgaacaaaggtctctggttttgctaggcagaggaccctgcgtgcagccttccgcagtgtttgtgtccctgggtacttgagattagggagtggtgatgactcttaaggagcatgctgccttcaagcatctgtttaacaaagcacatcttccaccgcccttaatccatttaaccctgagtggacacagcacatgttacagagagcaccgggttgggggtaaggtcatagatcaacagcatcccaaggcagaagaatttttcttagtacagaacaaaatggagtctcctatgtctacttctttccacacagacacagtaacaatctgatctctctttcttttccccacatttcccccttttcttttcgacaaaaccgccgtcatcatcgtggcccattctggatggtcgctatctcttcggagctgttgggtacacttcccagacggggtggcggctgggcagaggcgctcctcacttcccagacggggcggccgggcagaggggctcctcacatcccagacggggcggccgggcagaggggctcctcacaccccagacgatgggcggccaggcagagacactcctcacatcctagacagggtggcggccgggcagaggctgtaatcttagcactttgggaggccaaggcaggcggctgggaggtggaggttgtagcgagcagagatcacgccactgctctccagcctgggcaacattgagcattgagtgagcgagactccgtctgcaatcccggcacctcgggaggccaaggcgggcagatcactcgatgtcaggacctggagaccagcctggccaacacggcgaaaccccatctgcaccaaaaaatacaaaaaccagtcaggcgtggcggcatgtgcctgcaatccgaggcactgggcaggctgaggcaggagaatcatgggagcccgaggcaaggatgttgcagcgagctgagatcacagcagtacagtccagcctcggcaacagagggagaccgaagaaagagagggagagagagagaagggagagggaaagggagagggagtgggagagggagagggcaaattatttattttgtcatactgctagtgttcatttttacagagcagcaaggactttacaacccctgagtcacaatacaatttacaacactaagtaaacaagtgtatctcaacagcaaatactgcacctgctttaagacacaccctaacatataaatttaaataatcttgactgtaaactgtttatacaaatcagctgcattagtggttgtcttggtttgtgctgctataacaaaacaccacagactggttaatttataaagaacagaaatctatttttcacagttctggaggctgggaaattcaagatcaagacaccagtgggtttactgtctgctctctgcttccaaaatggtgccttctgagatgaacgttgcataatgccccttttacaagggccttaatcttatttacaaggaagaagcccccatggcctaatcccttctcaaaggccccacctcttaataccatcacactggcaacacctgagtttacaggaggacacattcaaccatagcaatagttcaaagacgactgtagaaaacctaaaacatatttaagataatatctccttactactagacaacccttattgtaaaacataagccagtatgatttatattaaacaccacaaaacactgaaaattatcatcattctacttatgggatatataaaagctgccagatattcactctttaagctagtaagtttatgttaggaatgtattagagctgcagaagaagacagaaacataaaattctggctactacttttgcaatataccacattgattacttcttttaaaaaaaaaaaaagcaaaaaacttcatttgtctgtgacacacaagtctcatgtcttctgccagcagccagaaacagtccccagctggcttcctggggtataataagaccctttctggttgctgatagtttgggcagtgaggatgggaggtgaggatatagtgtttacagtgaggatacagaggtggctttctgaagagaggggacaagggccattgtgacatgggttaggggatgtgagaagactccccaggatctggtaacaaatgatgggctaggctggggctgaaggaggtcctccactgcctgcctattacagattaagactgagcagtgggaactaggattgtgataagctgctcaaatggtgctcaggggttgctgtctcttctggagggaggagaaagagatgctattgtgtccatgaacagtaagcctcaaggtcccaaacaaaggccatgtgactgtggagtcaggaggtccccaccctgagctcatggacttgccagatgctggggttgcactgggagagacaagggagatggggcgatgcccaccccagagtgagaaaccaaagaaaagcagccccccccactcaccacagcagccccacgggctggcatcttccctccctgagctccaggtccccatgactgttgacacatcccaggtgtgcatattaaactcctctgcctgtgttcccacaggaggaaatgggcctggccaaaaccctctgtaggaaggggagctaaagggacctgtgggtgtaccttttgtgccaattcgatgtaccactcttgttgcttctagacttaaatctatggtagaaattgaggtggcaaggccaaggtgggaggattgcttgagcccaagagttccagaacaggctgggcaatgtggcaaagccttgtctctacaaaaacaaaacaaaacaaaaccaaaaacccacaaacattaggcaggtgtggtggtatgtgcctgtagtcccagctccttgggaggctgaagtcagaggattgcttgatcccgggaggtcaaggatagagtgagccataatggtgccattgtacaccagcctgggcaacagagcaagaccttgtctcaaggaagaagaagaagaagaagaagaagaagaagaagaagaagaagaagaagaagaagaagaagaagaagaagaagaagaagaagaaggaggaggaggaggaggaagaagaggaggagaaggaggaagaggaggaggaggaagaaaaggaggaggaggaggtggaaataatcaatgtagtatatgcttgaacatcccaatccctacagtgccagaggggatcctcccagctggggaggagctccaggtggaaggctgcgagtgagacaagctgcgctgccacttgcccctaggggctgggggatgcattaggatccagcaggagcctccatgccctctcatgcccatacttcccactgtacagatgctgccctgcaggtcaagagacagaagctccttctaaaagaacccagttgtgatgttgtcattcctctaccaacaggggtggctgataattacctacacgtaaagtttcccaggactgtgtgtgcatatccacagctttcgagccttctagcccttaaggaaaacttctgtgtctctcacacccacctccaaaaaagcccagtgctttgtggggggattctttgaactggagacagaaatatgcctctcttgggcattctatttggttctttatattggctaactcataaaccagcacctctaagtggggtccaatccagtgagtggtatagtgaagctgtctggcgagctgtggcacccctccatacctttgggtctatacaactctaatgtcctctttagtaagctacaagtttgtgtgactgctggtcttgctgatcgaattctctggggaagggaggcagcctccactcagaggcatgcattgatactttggattcattgatttcctgacatagctactaagtgcacccctctttaaaaggggggcagccattagccttctactgagctcttattaaagctgaacatctgatgaatgaatccttgtgactctcaggctaatgtacctattatgccaatgttggtgggtgggtcaacttggacttggtctctggcaagattgcccagcagtccttgctggttataaggggatggtgtgtttgaagacacaaccagcatgcccctagtgtcccctcagttttgcatgaagggatggcagctgcccctatgaaagtgtgcagtgttgggtcaatatggctcagccgttgtttacccccacagctgacctggtcagcaaatagaggctgcccagggatagccatgaccttagaggctgaggacctcacagctgggaagaccctggggatgctgacggtgcagactgcctgctgcctgcatccctcgcagtgggctgtcagtcctctcttgaatcaggttctgcggctgcatctaccacagcgaggggttgggctgctatggaacttggatgctgactgaggcatcaaagcccattaggaataggtaaaaatgagacccttatgaaagctctctgctcagctgagtttctgatggaagacctatcggggagggcccctgtgtaattccgcttctgctgcccatgcaggacgtgttcttggttttctttatgtgacaaatcacatttcctatagggcctaccctactgtagcttcataaacattgatggcaaaggaagtagaattcatgaaaaaaatccttttacgtggtttttaaaaggaagacaaatcattacatgagaaatctggagttctactgtgaatcaggaattatgaaagctgccacttcactgaacaatgctttcgactgcaaatatcaatatgcgaactttcacttaaaaagtggggaaaatataggatctctgaatgcaaatttgggagataaagtcggcctcaggcatgagaatcatggttcagtttgttccatccatgaaaacagagtaaaatcagtcccctctttgagaaagaaaaccatggatcagaaacatggtcccctccctgaaggtgggaaccaccttctagtcaaggtgaagcaaggaaggaagccgcccagccttacaattatctaaagcttgtgtgtatgctaacacaagaggctaactccacaacctagtgaaccgaacaaaactttggcaggcccaccattcagtctgcagcagagggctcaagacatatgtgatgtgtcttggatctagtccgtcctatggtgtcctccatatgacgaaaagacgagaggattttccaatcatttcactgcaggacatgtgcgctgtgtcagtttcccaaggctgccataacaaattacagtaaacttggtgccttcaaaacacacacggattacctgacagttctggagtccagcacaggcctcactagattaaaatggagttttctgcagggctgcatgcctttctggaggctctgggggagaatctgtccctgtgacacttttagggtccagaggctgcccacattccttggctggtgcccttcctccatctcccaagccggtggcactgcctccctctgcctttgtccacagtcacacctgtttggctctcatctcctccctcatccacttcttgtttgtttgttggttggtttgtttctgagacagaatctcactctgttgccccagctggagtgcagtggcacaatcaaggctcactgtagccttgacttcccaggctcaggcaatcctcccacctcagcctccccagtagctgggactaaaggcccatgcaccaccattctcagctaatttttgtatttttttgtagagagggggtttcaccatattgcccaggctggtctcgaactcctgagctcaagcaatctacctgcctccacctcccaaagtgctaggatgacaggcatgagccactgcatcctgccccacttgtaaggatctgtgtattagattgggcccatccagataacccatgatcatctccctatgttcatattggcaacctccattccccttcacctgtaacataatcccaaattctggagattaggactggacatctttgggaggccatgattctgcctgcctcatttacccattcaactataatcttcactcatgaggacatcaaggtttgtaagacatgttttcagtcattgtgaaaagtcacagcccaagctcggattctccaggagtgcttgctcagtccagacgtaactgaactggacacaaattcaccaaggcttctgcatcccctccacctccgtcccttcttcaagctaaaccttgccattctctgagactgaaagagtcactgcagcctctggtgttctgaagtagtgggagttctgctgtcttccccacactggagttaggaagcctctgttcttccctaagcctggaatgccgagagagctttgttctttcacacattctccacctctgctgaatccggacactgcttccctttgaggtaccaaggtggctgcagcattgctggagtcccctcaacagcgacttgaacaagaaaagtgggacaatctctttcagaagtgagaaaactctccccacatctcttcccactgctcagcagacttcccctgactggctggatgggggtcacatgcccattactaagccaatcaccatcaaagaaaagtgattgctatgcttggcttgataattgtctttgtcttagaccacgagacaagggcttggctgccatatgcactttttttttttttttaacggagtcttgctctgttgcctaggctggagtgcagtggtgcaatctcaactcactgcaacttctgcctcctgggttcaagtgattctcctgcttcagactcccaagtagctgggactacaggtgcatgccaccatgcccagctaattttttgtatttttagtagagacaaagttttgccatgttggacagactggtcttgagctcctgacctcaggtgatctgcccgcctcagcctctcaaagtgctggcattacaggcaggagctacagtgcctggcctctagatgcttttgggaagtgatcctaggaagaaagattgagggagggaggcagacctattacagggtgcactcaggagcacgttgcccatgtgggcagctgggtgtctccctggggaccctgtgaggaactgtgtagaatatggctcagaactgacctgccaagacacatggaatatgggctatttatccataactctgtacccttaaggcatttaatccttgtcacttccagggcaggctaatcaaactgcccccaccccaccgcaccccagtgtgataaaaataggcagagccacagacagaggcaggacttagacagggaagctgctggtgtgcacgtggactgtctgctatagcatggggtggactcaaggtggctgaggggatgtggggcagggcactagcctcaccgatgccaggacctcccccactacagcgtgggtagagaggacagcttagcgccaggccaaacaaacccgcccaggattggtgtctcctcctgggactgcttttggaaagcacttcagagttccaaagttgtggtggtaagtgtccatgcagtgagaacatgggacttaacatgtggcttagtgggcacataggccagtcagcctgaaggctgactgaatttggaaatcaacaaagtaattcactgcagtgaggaaatgctggccagagcgttcccagcagctgtgtgtgatgggcagggccagaggcccccccacccacgaagacatagtcatgcagtattacagggacccgcctccccttggctcataatcactctgccctgacagcagctgggtgctaggcccaggtttatccctcggggggaaaagaccaggtaggtggagacttcactcttctgggtctgctccaaagaaatggtgactctgaccttggagaacacatgaagacttggggcttgaggaaaacttcccaaaaaggcttggatagggaataggaacctgacttctgcttgtttatacaaatagaaataaaagccattttaaaaacatccccagcaatttcacccaaaatcaactattcgtggacttgaagagggcaggaggtgaagcatgtgtacaggaaaaggttttattccactcacagcccccagcccagagttttcctgaagtccaggctgagtggaatgtgaagggaccatcgactgaggggctgtcccttcgcagggaaggcagcttctctttctggggtgatttcagtgtggccttactagaccgaacaccaatatcccaggtgggctgctttcaaactcattgagccatgagacctgaggactaagctctgatttttttatcttgcccaaattcctttctaaggggtctggacgcgcatgacacacaacgtttggcagtagcacacagaacaggaaacgccaactcttttgacagcaaagggttaagtcaactgattatgttttttctgtcaagagccagagaaatacttgatattcttagttgtgtttctgtaatagttaataaattacacaacaaaaacctgactatataaatctattggtctaactacgtatttgtaacttgcacagtagtcaagcccttttgttactttgccccatcgtgctcttaaagccagccttgcagatctgtgcagaaacccagccccattttttttcctttagaacagccttccccattcctcaaaatggaattgaggaaatcagcattccttagtagattcctggcttcagtttttatccacggctgggaaaggagtgacctgcaaggctgctttaaacaccctttggcgtggcctgaaatcaaagccgcacccacactggagtgcagttgtctcaaatgagaactcactccctcagggcaggcacatccaggaagtgctaagacacttaaaagttcctagtgctggccaggtgcggtggctcaagcctgtaatcccagcactttgggaggctgaggtgggcggatcatgaggtcaggagatcgagaccatcctggctaacatggtgaaaccctgtctctactaaaaatacaaaaaaaaaaaaaaaaaaaaaattagccaggcatggtggcaggtgcctgtagtcccagctactcgggaggctgaggcaggagaacggtgtgaacccgggaggcagatcttgcagtgagccgagatcgcgccactgcactccagcctgggcgacagagcgagactccatctcaaaaaaataataataataataataaaataaaaattaaaaaaagttcctagtgtttttgagacccacaattacttacaatttatgtagtgaattctaaaaattaaaaacactaaaaaaggcattattttagcctgtatgtagttaacccattcagaatccaaacatacaaaatggtttatttaaatttaggaactgcccctgttactaagaattctgttttaaagaaacagtacgaaaagaaaaattctaacccaaaacaactcaaatcgttttccactaaatactgatacaaacatgtaacaaagagtataaaaagttattcatttaaatatgtacaaactcttttaaactcaaatactgttttaatacttatcgaggatatatacgacgaggtgaagaaggaaggtaagttgaaagagaatatattgcaacagcctaggcagtactgttaactctattatactgcaaactttttgcaacaaaaatgtcttttttattccagtgtggacagggattttcctcatggagcatctgtggctctttctaggctgagctcatccctttggatttgatgaaggccatgccgtgtgtccgcatgtgagtatttaaggcagcttcagtttcaaatttttgtgcacattttgcactttctgtctgacacggcaccattgggggattcatcctcatggctgggtttgttttctgttagttatcttccccagtcccattttgcctggacattggctgaggttcctttaacttgcgtacaatgaagaagtgcctggacagcgagacatgagacgtgtagcagaggccacactcccaacactggtaggaagaaccatctgatttgtgctgagggatctgtttgtggagctgctttcctcccagtgtcttctgtgaagacggcaggatcctaagtcattaatttgaagctcgctaacaacagcacgatgaaagccatggtcatatctgctgcctctgtccagagctccagcagagccaacattaaagccaccaatgccatccaacagcaaactgtcgtgctgccagcatccagcctggccaacaccaaactcatgccaaagactgtgcaccttgccaaccctaaccttttgcctcagggtgctaaccagttccctccttggtccttggaagattttgaggcagcttctcagaaaacaagacaataaaataatcgttgtaataaaacctgtacatgcttcaggagacttatcagaatgtctgggaggaataattgcttttctgaaaatataattattttttcaactcaccgccacggttacttctcttcccaagttccaagaaacctgataactcctccccacgctaagaagtacaaaggaaataaggtcaggggcgtccaagcagaccctgtgaacagcaggagcccatactgtgctgaaggggctgttattgccattgctggtcacctagaggtgctgcgttctggccacgcccacgtcggggtgcctaactccaggaaacccattttggtctaaaagaaccataattgtatattcctcatgaccatgggaagccagtgttcactcctggtatggaaaaagcagctcactcctggtatggaaaaagtaggttggtttctgcttgggaactaaatggcttctattttctgagttccctcctgcaggtaggaggacaacaaacaatatggcggtaggtcctgtttatgccccaggcaccgaagctgagataatgttctccaaaaactgagaacatccttgctggctgaggccctaattagagattaggacacgccttacagacccattgttctaacaaatagcttatcaacggcctagctcacagggtttgcagagctaaaggagctcttaatgaatcagaatttaacacattgaatctttgtttttaaaatgttgggtttgttgtttttgaactaatcacatctgcacaggggtctttaagacaataaaagccaacaatttaaagaagtaaaaggaaagaacctgatctactgatattcaacaacaaactgaaaactgttttgtgttagaggtcattagagctggctccaaggaaagacagaatcaaaatttacccaaatacagcttttccttcatctcttctgtgtctatatcccgtagtctgtgtgaacactgatttctcctaaggtgcaaaccccactgttaggaaccatgctcccctgagaattcatacattgacaccctaacccccatgtgatggtagttggagaggggtctttgggagtgattagggttaagaagaagtcctaatatgattgagttatgattagtgtccttataagaagagataccagagagcttgccagagccggttgactgtgacttgaggaaccaaggatggcccagtgtccctgggggcaacagatgccacagtggggagtgtggtgcaggagggcaggggcagccagctgcatgccaagcccttccttgggcttgtgtgaccctgctgtgcggcttgcctctgctgttgaatgctccaacactccccttgtgacagatccccgagaaaacaacctggagagcctctaacctcgggaaaacccggcggttattttattataacgtcaaaatccaatgttcatgcactaggtttttgagctttcaaatctccagtgcaataaatcccatcacagaggctttgagtcccctgcaggttgattctgtgactaatttcccaattgtttctttgagcaggagactgccccgcagggatcagtctggggacggctctcctgcagtccatactgatggctcccgatgctgtgtctgagcagagaaggaaaaacttgaagtgtcggcagaacgcctgagactctgtcacctgctgctccacactgactggagtgaggttgtgcgacaaggagagatctgtgtgcacagaccttctcctggcaggacaggggagggagggaggagataaaaaggaaattagccacaagccatggcaatacaagaacgctcatcacagcatttgttttaaataataggaaaaaggtagaagtgactttaatattaaccagtagagaattaggtgagctgtcacagaataatacgtacaatgaaatgccatgaagtcatcgttgtgtgtgtgtgtgcgtgtgtgtgtgcgtgtgtaagtgtgtgtgtgcgtgcatgagtgcaagtgcatgtgtctgtgcatgcctgtgcatgcatgtgcgtgcgtgagcgtgtgtgcgtgcgtgtgtgtgcgtgtgtatacatgataagaaatgaggactataatttatttgtactaaaagcaattcataaaacaagaacttagagcatgagaccgtttttgcttttcagtacatatttatacaggcaggctcgccagtcctgggttacaaagcaagacatgaaggtgacaaagcttgtctctacgcgttaagattccaggtgactttatctgttcagttcaatattgtctgccactcttacggtgaatataacataatccgaaacaaaggcgtttataatcctgaaagttctatgagctgaagacaaagctgacttgtatgaggctaaaagcttctttttgtatttcaaacaggctaatttagcaacaatatttggccccataatgacaaaagaagcctaatgttcctcttaggcatttggctggaaaagcagtgctttttcctgttgatttccccccgtgatttattaaagtaataaaggcttgttatggaaaattccaacaaagtgtgttttattatctttcacagggtgagcccagcaagacatgtggctccccatctgtccggttagggttcagggacttccagggtgaggggaggagggggactttctctgttccttctctttgcctgtgtagcgcttgttgatgggtagacactaccgtgtgtgatgaattattaatagaagaagctgtgagaccataaatattcaaggggatgcatctggtttcactgatgtttcatgtaaggcagaaaaagtacatttttaccaagtggaacaacttgtcagccccaaatctcttgcttgcctggacccaagcactacaaggagaggaaaagcatcttctgacactgcacataaaagtccagctgggacacactgtgtgtgaggaatgtgcagggttcagcctggaagagaccatgtgagctgacaatgtcgccatgtttccttaatggatgtgaggctgtctgctgggacttaggggaggggaatggccccacattttttccaagagaaatacggcatttcagaacaccatttgaagacttagaagaggacaaaggagatagaagcgtccctaagggagtttgcaggtggaggagagcagcaggtgtagagttgggggcttgggacccaccaggactttgccaagaccagttcctcccatgttttctgccccgggaagattaaaacctatgcagatgtcaatgtctccatctccggggcgtatttctgcttccaacactcaccttcagaagcagataatcaaagaaacagagtgagtaggaaagtgagcttagagcggaagagaagcgctcccggctgcacctgcttcaggaagtctctgactggtgctgctcacggaacgcgcacaattctgtttctcagcgtgggacccctccagaaggaccccccacaaaaggagtggcagcctttccaaggcatgttccataaaaccccaacttgcaagaacgctaatacatattatgtgaacagaaagaggtgcagagtaaaaagaccttcgtacgtctctgagaagacctacaaaagcttaccttgtgagtcttgaaggactgctaataagaccctaatggaatggccccaggggaccttggaaggcctggaaacattttttattgtcaaaattgagggcaagtggagggcagtgactggaagggaaggtgggtgtgcttcactgacgtctagtgggtgtaagccggggaaaccaaagaccattgcacagtgcacagtacagcccccagagcaaagaaccatctggccctataggtcagcagtgcagaggctgagaaaccctggcctaagtgtattggagacaaaacctccatcccaccccggaccctccccctttaggcatctcaatggtgtcctgcaatgcacaggtagggaaacgctgcctttgcactcagctctgaaggggatgagaacatgccagtgtagtgtgaaatatgtaaagtgtctgcgtgggcaaatcttccctcaagaccaccggggaatcaccttctccccagcaggctcctctctgggatcctcctccatgcttccgaaacatcatcaagcccctgtggtagcaccatttcctcagtccgtgagctttctcaaagacgtagctcctgccctctccatctcaccggcatgcagtgaagacttcacctccaaatatgtgaatgaggctctgagccctgaaggatttggagaaggcatagcaacgaattctgatgaaacctaacaactggttaagcaggtattaagggttgcagaacacaagatctcataactcaatgccccatatcctcaaaacaaaacaaaaccaactggtaggcgagggactgtgcttgaagaaggggaggagttctgtgtgtggaagagactggaagaagagaatgttcacagtaggtagctagtcgggtgggagcggggcaggtgagggctcccctccacacacccgggatgttgggccaccatcaagtgagggtcaggcagttgttaactgtttctctaaactgataactggttgcagccagcaccagggaaaggcagtctcctaatagatagaaaacacctgaaactcatcagcagcttcctgataaggtctcaggagttgggcgaggcgggagaagtagcacaagaccctggaagtatgccagtgtctaaaaccccaagtcaaaaggtcaagccgtgcacttctctctcaggttgcctgcctggccctcttctaagtgtgctttccttcctgctctaaagctttttttttttttttttttttttgcgatggagtctctctctgtcatccaggctggagtgcaatggcatgatctcggctcactgcaacctccgcctccctggtccaagcgattctcctgcctcagcctcctgagtagctgggattacaggtgcatgccaccacacctggttaatttttgtatttttagtagagacagggtttcaccatgttggccaggccggtctcgaacttgtgaccttgtgatctgcccacctcagcctcccaaagtgctgggattacaggtgtgagccactgcgtctggccctctaaagctctttaattaactttcactcctgctctaaaccttgccttggttggtctctcctgccttctgcttcctcagtcgaactccttctgaggaggaggcaataattgaggtcactgcagacctgtatggatgctgtgagattgatgctcgccccagtgtgagggagggttggggtgtcctgatcaggagaggaggaagttcacctgagacacaggtgagtccacaaatcagcacctgtatgcgaaagatgcactactcaggggagtctcagcagatacgactgggggaaaagacagcagagaacaaatatttagctctagttgcttgcaaacattattttcgcccaatacttttttaaacacaaatattcttgacttaagaaaatgaaaaaggggttaataggactttgctgtacaagactaaacctgtcctatgggctgacctgaattaatataaatagtagatcatagtgtcttgatactttatttctatcccaggttattttgaagccatttaagcacagaaatatgaaaccacgctaagattctgaagaagcaactgtttccccaacatttttctccaggaattccaaatgtctctggggggcattcccataaggtgggtttacacttaataattcagttgaaaatgcagcctttattttaaatctttgtgatctatcttcctttttaagcttttaaatctgttctcagtcaactggttttgaaggcagagaaacaagtttacactggaattcatgtacagttaatgatctctgtactgctcactgggtgatgttttcacatactttcaagtctaggggaaaaacatgctaatgaacattatcataagttaccaaaaggtgaaagttcttttctagaactagatgtttaaaggccactgccaaactgccccgttgatttctccatgtggcttattaatgacagaaaaccaaatgaccaactattaaatttttatcaactcactaagtcatatggtacaagcccattagcctcatacttttctttccctcattccttttttgtttcttgtggtgtgtatggtggcgaatctcactgtgttcgggatagaactctgggtggccatcagtgaagtatgaggaagaaatggtagcaatgagggtctcacacacaagattggaggtggaggcccccagcgcccaaggagggcagacatcaagcccctataactggctgtctctgtggcagccaggccagggagtccaccgcagcagccaggagaggcagggaagtggctggggagccatctccctcaagtcaagtgcactgtcccagaaaactgcagacagtggaaggacagagcactcccagctgtcaggaaggggctcttgacccttaattggggacaaactcagaaacgttcacccaggattcggaggttggtatgaggactgagggcattggctgcaggtgcactgtgggtctagcttttcccctttctctaaatgatgctgtgggtgatattctcgacagcagcaccctgccctcttaaccagagagcctcacccctgaaagacagattgaagtgtatcttgttaacataaacacagagtatatgggagtgttacaccttttctaatgattgcacataagaagttaaagacttttttttttcctccagaactcttagatattattaattagatctcattctgcttattgaaagtctggatggagacccgtattcactttaagaggactgactacctgggggtgttgtatgactagggtgttattagagatatgttaaaaacacaggtcaggcacagtggctcatgcctgtaatccctgcacttttgggtggctgaggtgggcatatcacctgaggtcaggagtttgagaccagtctggccaacatggtaaaaccccgtctctactaaaaatacaaaaattagccgggcatggcgatgggaacctatagtctcagctacttgagaggctgaggcaggagaatcacttgaacctaggaggcagaggttgcagtaagatgagattgtgccattgcactccagcctgggtgacagaatgagatcctgtctcaaaaatcaaagaaaaaaacccagttacacattttactgaatagaacctagggactcaatgccagccagctatgttgaccccttttctgtgtaaaattttatgatgatgctgtgtgtatttagtgaaagaaaccccactgtcccaggggcgactgatctgaccccaccttgggtgtgtgcagagaatatcatgtctgtctagactgggcacggagaccccctctgcaggccagcttggcagtaccctgtactgcaacagagcactcccaacttaggagagggatgggtgagcggatctagcagccgctcaggctgagctgggaccccgatgaccagttagttttccatgaagtctcttgtctatagcgatttctcttctggcaagttgaaatcaggcctaaaattattagaggaaagagtagaaaagcttgatgtatacattcagctttctgctggtctccactcctgtctgctctgcgcatctgtccctggagaggcagcctgtccttcgaacagtgggtcccctctgctgtggtgctgataggcctgaagggcagctgcctctgcccctgcccttcctctgtgcagaacttggggtctccagctgggaggagttcatctccagcaccaggctctgtgcgtcccctgctcctggcttttctgtgtgcccagagactgtcagggctaaagggatctgtctttttgtcccacttacctcatctctgacttatagtacagcttttaagtttcactttcttttttttcttttgagatggagtctccctctgccgcccaagctggagtgcagtggcgcgatctcagctcactgcaagtccacttcccgggttcaagcaattctcctgcctcagcctcccaagtagctacaggcgtgcaccatcacgcctggctaatttttgtatttttagtagctacagggtttcaccatgttggccaggctggtctcgaactcctaacctcaaataaattgctcatatttacctgggaatattttatgaatttatgagcaaatagaaatgtaggtacttttccccccttattgtccattttctactttacagtatacttggtgtattattctactcacttataaaaagcatcctcaatcaatatttttatttttttctttcttgcttgcttttttttttttttttttttaatttaaagagaagaggtctcccaatgttgcccaagctggactctaactcctgggctcaagcgatcctcccacctcagcatctacagtagctgggattacaggtgtgggccaccatgtctggccacttttctttataatggctgtagttttcctctctttctgttgtagtgtgtctactaggaagcttttagaaaaattaaaacaggatgggcaaaataggctcaagtgtaaggaagggaggtctgcatttggggaatatttccagcgggctttgattgctgttattgttgtttccatggaaggtgggttttgttgattttatggctttcacggctctccagggctcccagcagccgcctggcacagcacagccttgcagagcccaggcgtgggtgggacagatcaggtttgcatcctggctcctccacgtcccaggtacttgatctctgtctaagttacccatctagtctgtcttcccacttgtagaatggggttaataacaacaaataatttaaatgtgactttcagggcactctcaagggtagcatttgtgcacagaaaacactactcagaagtttataagttaatattccatttattaaattagcacatttgtattagtctgttttcatgctgctgataaagacatacctgagactgggtaatttataaagagaaagaggtttaatggactcacagttccacgtggctggggaggcctcacaatcatggtagagggtgaaaggcacatcttacatggtggcaggcaagagagaatgagaaccaagcgaaaggggtttccccttataaaaccatcagatctcgtgagactcattcactaccacgagaacagtatgggggaaccgcccccttgattcaaatatctcccactgggtccctcccacaacatgtgggaattatgggagctacaattcaagacaagatttgggtggtggcacatccaaaccatatcaacattaaagctagctcttacttttagttttcacttaatcttaaatttaaaaaaaaaatagagacagggtctcactatgttgcccaggctggtctcaaactcctggcctcaggtgattctccaacctctactgtatctaaatccattttggaaatcacattctctccgcattctaacatttaagcattccccgcatgtaatggccaggtcctcaccttttaccctaaagtggaactggccagtcaggaagtcctgcatgcttacacggagtggctgccagtgccacacagcctgtgcagctcctgacagacaactgacaatcagcaggcactcagagagctagcggtgagacagtgaggccgagataaacaagcaaaaaatatccagcagagaagtaattccaagaatagatggcatctttggaaaacaaaactcaatattaactcgtatcctcacacttgtgtggaaatattgcatctatgccacaagaatggcatactgagaaaagacagctagcatgagaaagagctcttagaaattaagattcttgaaactataaacttacagaaggattggaaggaatggaaaatgacatcaagtctcccaggaaggagaacagaaagaaggaaaatgagattaaaagaaagctttatagatggtgaatccacgaatttgcactccaggaagcgggaactaaaaaccgcagtaaaccatcagaaatgacaaagaaatttccagagtttaactagcacaaccttcagaatgaaagggccaaggagggccaaaaatacgtcaatactgagttatacaaacataatcctcataaaattagagccccaaacataagaacgatcccaacattttccagagcagaaataacatttaagaaacaaacatcgggctgtcattcaatttctcagttgcaccactggatcctggaagactgggaagcagttccttaaacccttaggagaatctgttttaatctgaaatgagtttggctacataaggaagttaaatgtgaaaacagaagaaataatcttgaaacaaaatcaaagtttatttctcttatattcaaataccttgggaggctatctgttgaacaaaacaaggaaaaataagaactcctctattggaataaagggtggatccaatctaaaaggaagccgtgaaggggggttgcaggataatgttatggagagtgacaagaaatcagtaagtccatgtgggaacagtatgacttcacgtttctattagaaagagtggggagggttatgcagatggtgggatcctgagcaggttggaaggatttaaagatgagactaaaagaacacaaaggaagggggaaactccatcagactccaggaaaaataaaactgttaatacaatcacagtttactgtttgatctggcgtggaacagtactttcttgtactcaggatgcaaactcaacttactgattttcagcttttagaatcaactaacaggcagcagagagaagaccatgatggctgcagaattgaatgtgacctgccaaccttaacaactctggtaaggaggaaggggaggaagatgtaagacagagtatgacaaccctcatgcttctgtacaagaggctagagagacatcatctgtagttggtaacctaagagttaggcatccaataaggagctaacagtgaaccaaattctcatccttgatgagaaggaagtctgtaaatgtgaaatggagcaatggagaaataataaaagccggtccatagagatgaagacaaaacactcatggggttgggggcggggcagctcacagctcgtaatggttatttctgggccataaagccagagctggggagaagtggaggagcatagatttttatcaaaagcaactatctatttgaattttgaatcatgtacactgatacttaaattttaaaaagtcaaaaaagagtttcagcatctcatcacttttgtgcttcttccaatccttagagcaaacattggggagggactggagacagttattagacctgctacttccactttctcgcctgggggccaggagttagcaagctgggcggcttgtcgtcagggccaggaatgagctgtgagctgagcatggtttttacatttgaaaatgtttccattttaaatggttctatagggaattacccagtagactcagttttgccctcctggcactcaaagccttaaatagttactatctgtccctttttaaaaagtttgccaaccgttggtctagaggctcaccctagagattattatatgaatgtgtttaggagatggcacatgcgatgatgtggagggcaggctttgggagagatgtttaggagatggtgcatggtgatgtggagggcaggctttgggagagatgtttaggagatggtgcatggtgatgtggagggcaggctttgggagagatgtttaggagatggtgcatggtgatgtggagggcaggctttgggagagatgtttagcagatggtgcatgtggtgatgtggagggcaggctttgggagagatttttaggagatggtacatgcggtgatgtggagggcaggttttgggagagatgtttaggagatggtgcatggtgatgtggagggcaggctttgggagagatgtttagcagatggtgcatgcggtgatgtggagggcaggctttgggagagatgggcagggcatggacctgctggctacagacagtcatttctcactgcagccgcaggtcattcgaattcacaatgaagctgaagaccatgaatatgaagagttcagtgtggttgctggcatgggcaaatcctcaactgtgtcctcgggctgcagtaccctctggtggagacccttcccttggggatggagaattggaccctctagcaagagccagcaggccctaggagtcagatgggcaccaacacgactgggctcacttgtcatcatgaagtggcagctgtgagacttgggacaaccaaaagtgccaaggatttggggctgtttctgggacctggttaggtaggggctaaggtgtagacttgagaccagcagtggcagaaggtaggggcttccagcaactggagttcacagtagacacagggatgccccaactaacagaggggcaggtggctgtcaccaatggtgatcactgtggagccactgcagcaacgagctgcagccgctcagaggctgtgcagtgagaatggcaatgtaccagaagagctccatccagaagaaggaaagagtgaaaagccacctttccattctatttgtgaacctgtggtttaaaactgctggtttaaaacaccatctgctacaaacctggacaggttggaactcaggggagtggccataaatgcatcttagtcttcaaaagctgtagattgttttgtaaatccgtgttgtttttcttcctggatgcagtgatttcacctaaagaaagttgttcctgggagaaaaggaagcagtgaactgactgcaccaggtgaacgtgtacagtgacaatctagggctttccatgtggctattatctgagggctctggcctcccttaaatatttacactgttcagcttgtgaaactgcccctatacattttacaaaattaatcagagaaaaaggaaggggaagaaatgaaaataagccaagcttggagcacactcagtatccatcatgaagtcagcaggctccctgggccccttcctcatagctgtttggtgcctattgccccagaatcacatagactctgtcacagattatcattccccttaattgctctatacataacatcttgaacattataaaacattaaggcttgcctttgagatattctttcagatcctgcataccagtgaaactactgagaccagctgccgtgaaggactccacaaggagctgactcatccaagaatgcaacttccacatcccgatgacttcatcccccgtaccctgaccaatcaacgaacccacttttccaactcctcgccctccatgatccctttaaaaccccccagccagaactcctcagggagacaaatttgagggtcttctcccatctcctcatctggccaccctgcaatcactatactctttctctgctgtaaaccctactgtcttggtgtattggctgttactgtgcagcaggggtatggacctggcagtcctgtaatacttgaagttactcttgagcaaacctggaaattgtcaatagtagtgttgaagctaatgtctggacgctatgggacagcacattcgattttttgtttgatgcaactaatacaaacatagagtaaattcagtattaatgtgattttagagtctctttcttttgtgtacaaagtagaaattactttcttttttgccttttcagctacagtggtttttatggaaagaagaatttccagagcgtttcttagaaaagagagaagaatgaatttctctgaatttgaagacacctccaaacccatcatccctccttactgacctcaattccatcagatgcctgtttctgaaccaatcgtttgcctgtagggggttgagactaatcagcctcccgccaggtgaggtcagctgctcccaaggcaggagccagatacctggtctggctgaggcctgttagtaggcaggaagtagggcctgtatccatgagcaaccaacaattctcttgccacctctaggctcagctactcctcaggtgagcaaaagtggttcctgaacacagcagaaaagctaccagggaaaggggcttcttcagtaaagttaaaatttcagtcgcaatttgatttggctgttcccttgtcaattaactgattttataaaaactcctttgtacggaattgttaaaaattggcctttttttgttttgtttttgtttgagatggaatcttgctctgttgtgcagtggtgtaatcttggctcactgcagcctccgcctcctaggttcaagtgatccccccgccttagcctcccaagtagctgggattacatgcacccaccatcatgctcggctaatttttgtatttttagtagagacaggctttcaccatgttggtcaggctagtctctaactcctgacctcaagtgatctgcccaccttggcctcccaaagtgcttggattacaggcaagagccactatggctggccaaaaattggcctcttttctgtgttggaaataatgggataaaattagaaataactttgcagggtgctttaacatggcaagaactggatatatcctcgggttgggtgaagaggagcttcttagtgatgttaattggctatgtaagattccacagttcaaggcaaccagaatgtaaaagcacaattcttaaattgtttgaaaaaaaaaatgcaaccagttcttgttatttgtgatgggttctagaaagtcactgtgaacaccgaattagcaaacactgacctattggtcctgtgcaaatgtagcatagcgtcctgtgagtcctggtcataacatgttttgttactgaagtaccatttgtatgatgcaggttcacttgccaatgtctttataaaacaagcatcagcattgaaacctgctcttccacacaatccttttcctaagtgtataactcttaggtatttaaaaaattcttccatagtctcctgatctgcagaacccacctcacctgcaagtttaacatttttcacactgtatcaccttttgaaatgtgtaggctgctagcactagccaagaagagtttaacgttttcctgaccctgcataccatggtcatacatttctctaaatttcagcctcacatattgctctccactgtactttgtaaagtcagtcatcatctcatgaacccacaaacgtagccaactttccatttttcccataacatcatcacatactatagatgttactgtagcaccttctggcatggcctcctgtgcagatgggcacattggctctcctttctgcatgtgttgtgttgttgatgcatcaacgctgaactcatggccagcaccataaggcacatcacccatggccctgctgggcttcggagcacagacagcacgtcagcattgtgcttgggactattttaaacagccatatcactacaaaaacacaccaaaacgtgaaaagcatggcacaaaataggccaggaggaagactctcgcttacggcatgagctggaacaggaaggcagagcgttgccctttcaacttcagtgaggaatgtgcttatcccgcaactggcactcttcattgctctgcacatgttctccagtgaccacgaaaatgccatgagtagtgacttgggtgttataaataaatttgcacatacaggccaggcacggtggctcacgcctgtaatcccagcactttgggaggctgaggcgggaggatcacctgaggtcgggagtttgagaccagcctggccaacatggcaaaaccccatctctactaaaaacacaaaaattagctgggcatcgtggcatgcctgtaatcccagcgaccctggaagctgaggcacgagaatcactagaacccaggaggaagaggttgcagtgagccaagatcgtgccattgcactccagtctgggtgagagagcaagactccatctcaaaaataataataataataataataataataataataatgcacatatggaatccacaagtaatgagggttgactgcattatgtgaaataagcacatgcccaatttttacttcactctgaaaaagcagagtcaagaaagctggttcacaaagaatttgagaaactgggtctgcatggtgagactaggaatgctaatggaaggttgctaaaaaccaccagaaggcaaggaagctgtaaccttggggttatctcacctcaaagggacaaagcaaagatagcaacagagacttcttaagctgaacacattcctcacgggaagctccgttaagcctccacaatggctttcaaagacagtgccctgaacttacaaacagccaggtcctcttaccaaaagctacatgacaaaacgatcagcctgagttgcatatgccatggccaaggactccctgctgggaaacgtcactgtttctcacacagatttagagacatctaaacaagttctggttgattgcatgaagaggacaccatgaaagtggttaatgccgttctagaaacaaagcaaatgagtttcaatcctatggctctgtgaaaagagtctctgatttcaggactataaatacattttctcaatgaataaacttcatggtcccatttcttggtgttttgaccctgatttacattgtgcacacaaataaaaattggatttttatatttcctttctcctcttttaaaaacataagattttgatttaaaactgtttcagttacaattgataaaattcagctaaaatcagattaagcaacaggaacttattggctcatgaggggaaaaataagggtgtagataccctcaggcatgactggtttctcttcttgtttttaataacctttttatttcagactagattcagatttggaaaaaagttgcaaagatcatacagaaagttcccatctacactgcacctggtttctcttattagcatagtagttagtatgacttatcacagttaataagctgatattgacacagtgtgattagcaaaagcccacactttactcagatttccctgtctttacctaatgtcccttttctgtctcaggatcctatgcaggattccacgtcacctttacttgtcaggcctccttagctcctggtggctgtggcagttccctttgtttcctggttttgatgacctggacagttttgaggagggctggtcgaacatttcgtagcgtatccctcgattgagactgtcggatatttttctcatgattggactagggctgtgtgtttgggggaagaagactacagaaacagtgccatttcctcaccccttgattgcttggctgaggttgccaggtttctccaccgtaaagttactttttttttttttaaaggtgtgcaaattaaatgagtggtttctcatagtcaaacaaccggtttctcatagccaaacaaccggtttctcatagccaaacaaccggtttctcatagtcaaacaaccggtttctcatagtcaaacaaccggtttctcatagtcaaacaaccggtttctcatagccaaacaaccggtttctcatagtcaaacaaccggtttctcatagtcaaacaaccggtttctcatagtcaaacaaccggtttctaatagtcaaacaaccggtttctcatagtcaaacaaccggtttctcatagccaaacaaccggtttctcatagccaaacaaccggtttctcatagtcaaacaactggtttctcatagtcaaacaaccggtttctcatagccaaacaaccggtttctcatagccaaacaaccggtttctcatagtcaaacaaccggtttctcatagtcaaacaaccggtttctcatagtcaaacaaccggtttctcatagtcaaacaaacggtttctcatagtcaaacaaccggtttctcatagtcaaacaaccggtttctcatagtcaaacaaacggtttctcatagtcaaacaaccggtttctaatagtcaaacactttcctctgggctggcttcattctcatgctctcagtggcaaagagagctcctagtagaaaactcaatgagaaaagtgaagaacatttttgtgatacatgtttaaaactgtcctggggatggtgtcgttggcctggctggggtgacatgctcatccatgaccagtcccagggcccaggggtggaaccccctgggtgaggtgaggtcactgctcactggtgatgaggagagtgggcggcaccacaagagccctggactgagacgaggcgggtgattccccacgggaaaccaggggctgtcctgaagggaaggaagggggcataggaggcagatgagtggacgtccaccccaggcattgtcatgggaaagcttgccaaacacacgcattgagcaaggtggaaggatccaggttttgggaatggagcagaccggagaaaagggatgcaaaatatcaaaatacagatctttcaagtgcgggagtctcagaagaactgcagagtgtttcatgtgacatcactgtgccttttaaaaatgtgaatcgaaatgcctttaaatggtcatgtgcttcccacatggccctgaagtcactgtgtgccacgggatgacagtgggctgctcgtgagacctccacctgcccggctcccagcaggggtgtttgcgaccccttctccagcaagggggagcgcctgagctttgttactgggagatgcagatggctttgccttcactgcagctctctgagaccacagtcagatccatgaaggattttgatcagcaaacgggtcaggtaaatggggtctgaagctcctctgtgaagggatgaccactatgatacctgcaaccccatcactgtcccttgtcctgacctctctgtactgaaacagtccacatggcccttgggtctggaagggctcaacccatcaagggctcaacccatcctggcaaggaaacaggtgagttgaactaaattgaatatgtatcgggcacttccttccttgagggctgggctcaggttttatgcaacttctgcggtctcccaactcatcaccctggcttcacacaggccccagtaattgacgctgcctggtgcagatcacagcaggttggtggcactacatggtcctgaaacagacacaggcacttacggctggggtctgtgatcaatccagcattttggatcagcagggacaactgcttatcaatttagaaaaaagcaaattagaacacgacctcatatttcagatatatatatgtgtgtgtatatatatatatgtgtgtatatatatatgtgtgtgtgtgtgtgtgtgtatatatatatatatatatatatatatatggaagactttgcaaacatgaaatcaaaggacagaacccattacaaaatggacaggaccatacaaaatataatttttatgtattgaagagcaccataagcaaattgaagctaccacttaggatctctaagaggtctttatacagtcagaaaatgagctctctcatacacaaatatcttccagagcttgtatgatttctcaatttgaaaggtaacagttctttttgtggttttaattttttctgattactatcgcatgatcataagtaatccctttgaaccctcttcacccatttggcagtagatcgcctcacctcacactggcgtagagaccttggcagacacggcggggtgatggtgcagtcatagcgtggagtgccacacagtctcagccactggaaagaaggggactgatttataactggaaaggatttccatgttgtattgttatgcaaaaatagcagagtgcacacaaaaatatgtcatacgatcttccataaaacaaagtacacagcccttatgtgaactctcatgccaataatccagtattcatggatctctgtgtgaccctggggtagggagggggtggcacaacacaccccagacagagttcatggccaacgtgaggggaagagcggtggagggagtggagggcgaaggctttgaagagaggagaaaggtgattttcatgatagataaaaccctgtgtatattcaagtgaaatttttaaaacttgaagagactgagaattgtagatgtttgaaaggcaagtcaccaaaatattaatgatggttaccattggacatcggcattttgattcgtgatttttctttttctctagggtatttataggtatataatcagcatgttttattgaactgaagataaggttacctagggtttgcaaatgtttaacaaggacaggtaattttgcacactaacaaagaaaatacacattttttagaggacaatttagaaatgtgcttccaaacataaaatatgtgcatgtccttagtaagcaattcaacctgtttatagctttattaaaacagtaaaaataaatagaaaataatacatatattcagcaaatggggattgattaaattatgacattttaaaaacactattaagctttcaaacacattatttttagttatatttctaacattttttaagatggcaacttttgtttagaaaccaaataacaaaattgaattaaaaaacccaaagtggaatcccaatacagaaaacagctaaaagtggagctacactggctgggctgcggtgaggcccagagccctgttatcctgcctccctctgtggcagcccctaaggagcaaaacatgaaagcaactgaccaagatgagtgtttattggcaggatctatcatgtagaatgaagataataaacattattatgctctttttgtaggaaatactcatatattgagtatttttactttaacaaggataaaagtatatgtacaagaaaattagcagtggttattcctatggccatttaaaaatgttagaagtttgtattttctacaatgaatattaaatgatttttgtatgaatttttttttttttttgagatggagtctcgctctgtcacccaggctggagtgcagtggcgccatctcggctcactgcaagctccgcctcctggattcacaccattctcctgcctcagcctcccgagtagctgggactacaggctcccgccaccacgcccagctaattttttgtatttttagtagagacagggtttcactgtgttagccaggatggtctcgatctcctgaccttgtgatccacccgccttggcctcccaaagtgctgggattacaggcatgagccactgcgtccggccttttgtatgaatttttaagtcccctaaaacccttttctttttttctttttttttctttttttttttttgagacagagtcttgctctgttgcccaggctaaagtgcagtggtgtaatcttggctcactgcaacctctgcctcccaggttcaagcaattttcttagcctccaaagtagctgggactacaggcatgcgtcaccacacccagctaatttttctatttttagtagagggggtttcaccatgttggccaggctggtctcgaactcctgacctcaagtgatccacctgctttggcctccaaaagtgctgggattacaggtgtaagccaccgtgcccaaccctaaaacccttttccttgttaaaagtttacattgtgatatggtttggctgtgtccccacccaaattttatcttgaactgtagttcccataatccccacataccatgagagggacctggtgggaggtaattgaatgacaggggtgattaccctcatgctgttttcatgatactgagtgagttctcattagacctgatggttttatacggggcttttcctcctttactctgctctgcacttctccttgctgctgccatgtgaagaaggatgtgtttgcttccccttctgccatgattgtgtttcctgaggcctcctgagccctgtggaacagtaagtcaattaaaccactttcctttataaattacccagtctcaagtatgtctttattagcagtgtgagaatggactgatacaccttcccaactaaaatagatgccttgctttaggggccctcatatccttgggaaacttgtactactcaccggtttatcatctttgaacatatcagcaagcattgtataagggtgccttcctaaccagcacataaccgctgaacagcaggagccttacgatgtattcagagagagagacagagagaagaaatcggtgctaccttgtgttaccaagtgctaggtgagtatcattgacctgcattaaggaacatttctcttgaacctctgttgacttagatctgaacacataccagaagcataataaaataaacatgaagctggggaaatcctttgtttctggctctttcacattcacaacacaattctatacattgaatgagaacagaaactgttcctgggaacagatccgagcaaccctgtcacggagtaggaaggtgggacagagtggaggtgggcacaatgaagacagtgtaatcaggatgccaccacagggccaacatagcttcacacacgggcctggatctgggccagagtggaacacagcccaccagagaggatcgcagcccaccagagaggaacacagccctgcagagaggaaagcagcccaccaaggaggaacgcagcccaccagagaggaacacagcccagcggagaggaacacagcccaccacattggactgcagcccaccagagaagagcacagcccaccctcagtccctgtgggacctgtccttgctttctctgacttgccataggagcagcccatcaggctctaagaaggccccaggctcccgtgagaattcgaattctgcaggaggacatcgaggcagcaggcagtgaagcggtgaggggtgtgggctgagtgccgagtggacgcactcccaccagcaaggcccaagcagcggtggagacacacagtgtgactggctgggctctttagtgttcagaaaccaaaatgccagtgttagatttaatagtaaaaataaaaaaaacaaacaacttttaaagtaagatcaggttcaattctaactttaatttatttctaaatatcagcttcggttttggaagagtttgcatgaagtgtcacatggtgggccatggcctcacccttggaagaaaagggaagtcagtagtgaaggtcatagggggagtgacctggaggtctcttgagcctgaatcaccagtggagacatccgtgtcactgctggaaggacaggaggtgggggctcaaaataaaggggttgaaagctcaaaataaggatttcagaggcaattcagttcttcatgggaaagggtgtggtcctgggagtgcgtgggcatggtgggatgggagacaggtcattggaggtcacgaaagggagaggggtggaaaggagggccacgtggatgtgaaggcaccaagggtggggcaggccaccggtgccaaagccagcgtggctgcggggagggttggaggtgggaataggagggcatggtacccagtgcacttccctcacagagaagggtggtggggataggacagaacttctctcctcccaagttcaacaattggattagatgtgcatttaatgcagattctcaaaatgacaaaatagtcactttattttcaagcaaatagggtattttatttcattaacctgatacctgcctcttccctgatgccactatctcccctaagcctttgagtggcagctgtttttccatcatgctccagctgcctcagaggtggtaactacaatttctccaacccacctcctccaaaaacgtttaattttcaaaatcaatttagatgcgtttccaagcctctgtccccagaaggtggtagaaacttccatctgccattttggccacccctattctcttgtgaccacaccccaccacaccccagagtcacacaaaggatccctgagtcaacaactagacaaccagatgcaacacacacacacacacacaagtgcgtgcacacacgtgtacccatgcgtgagcactcacacacacacacgcacatacacacacacacctgtgcatgagcactcacatacacatgcacgcacacatgtacccatgcatgagcacgcacacatgcacacacacatatgcacacccacacatgtacctgtgcatgaacgcacacacacacttacccgtgcatgagcacgcacacgtggatgttgtgtcaccgtccacactccccgctggtcccaccaataggactaaagccctcatccttctggctggccgctgccagtgccgtcagctgaaggctcccggctaagtctcttccggtctcatgggtcgctgcctgacccatgccccattcctggtagcagttgccatgattggtcaaggtagagcatgaagttagggaacagcccagagaccaccctcactgctgacacccactgcaagtttggggagctctaagaccatctttaagtttgataatttgctaggaggactggcagaacttcctgtgagcggctctagtcttggttatggttattagagtgaagggattcaaatgaagatcagccaagaaaggaggtgcgtggggcagggcccgagagagctccaagcgtggaactgttgccgcctctccccgtggagctgtgtgcatggcacctgcttccccagcagcagcctggggcgaccccaaggggtgttgctagccagggaagcgcatggagttggggtctggggtcttggttggagctttgtcgcacagacccgactgactctacgtgttgctggccttccgtctccagcaccccagaagtcaggcggatgccatgtgagccaaggtccccctataaatcacattgttagcatacaccatctggcctggcccaaggccccagggaaagaaaggtattctaccaggtgggacaatccaagggcttatgcatcccagaggcaaaggccagccctccctttgggtaaggtgaaattctttactgcagtgggcgtacgtagaagggtctgcctccatacaccagccccaaatcaggccaattctgccgggccatctgggacccagagcaccctgtggcatcagtggacactctgtgggggcctcctagcagctccccggcccctgatgctcagcccacttccttttctctcctatacatgttgatgccaagtgcataccccaaatgcccacatcctcttctccaccccagggtctgttcccaggagccccaacctgggcacccagtgcacacacaccctaaagaaactccaggcctaagaaagcagctaagagtcttccttgcatacaagaatgttccttcacttggcagtagtgaaaaactggaaaaatctgtcaatagggaaatggataaataaattgtgagatagtcatacctaccacagagcacttcatagtatcaaaatgaatgaagtactctgtgtctgataacatgactgagctttaaacttaatgttgagagagaaacaaacaaatcacggaaagttagtctcgttgtactatttacataaattattagggcacaaaactatatgttaacagaacatacatatttatgaaaactgaagcaaatatggcataatattaacatttattaactgtgggtagctaaaatccctcacgggtatctgatgcttgttttactatttttatcattattattactacagattgtttatcattcgtgtttttggcttaaggtcaaagcgtgagaggcggctctgccaccgtccgtatttcttgccctctgagagactcacatttctccattggcttctgctgagctctgcccctctcttgggctgtgggattctttgatgaaccctggggccttggtttctctagggcaccactcagacagctcctagggagcagccacaggcggtcttgttgcctgaggcccctgacccaatctggtctggaatttctgggcaaggagtggccgaccctcctgtgtatgggtgcagcatggcaccagccactggcgcatggggtgcagcggggattggggcacatgggctgtgcgggggtgcaggtgaggtaggaggatggggagtgggggtggcgctcaaagacggttttttgtttgtttgtttgtttttgttttgttttgtttgagacagggtttctctcggtcacccaggctagagtgcagtgccttcatcttggctcactgcaacctccgccttctggcttcaagtgattctcctgcctcagcctcccaagtagctgggactacaggtgtgtgccaccatgcctggctaatttttatatttttagtagaaacggggttccactattttgaccaggctagtcctgaactccttatctcgtgatctgcctgccttgacctcccaaagtgctgagattacaggcatgagccaccgcgcctagccgagactatttttttttagctttctcctccaaaacatacctccagctgagaaggttggattgacattgtgcttagttcaaagaagaaacagctcaaggaattccacggttaatcatggagtacgtattgaaagatatgcttagaataacaagcgcaaggagtgggcttaagttacaacctgaagactggcgttggtgttaagggacacttttatttgtttttctgtgaaatttctctaattttttcctagttaaaaaattgagtcatgagtctttctttgtgtcagttcgtagactccatcacagcatacagaggaagaaaatcttcaagccaagctgttcagcctcagtccaaaatcatattctacttacagatccggggacaaaaatgccaattctaccattcatgatagttctgaatttgagcccaccttctcgagggctcagttgacagatgttttatctgggtccaaagacattgaagctgaccgtcagctctgccagggaaatgagagagagaaactgtggctcctgccccgacagtctggggtcccaagtctgcaaagtttacccacctgtacaaggtccgccaagtccacaccaggcggacagcagtgctttcaaggctttatttggggaggggtctgagggatgatgccatctccccaagttcagtgtggagccacttccttctttgcatcattattccttagttttctgccccttcctttgggaacatcttcttcctgcaaacacagtctagctcttactcattcttaccaagcccgtggcatttggcattgcaagtagtgtctggacaacatcagagctatagatatgcacacattttacttttattatttatttatttattcactttttttgagatgaagtctcactctgtcacccaggctggagtgcaatggcacgatctcggctcactgcaacctccgcctcccaggttcaagtgattctcctgcctcagcctcccaaatagctgcgattataggcatgcatctccacgcccagctaatgttttgtatttttagtagagacagggtttcactatgttagccaggctagtttcgaacttctgacctcaaatgatctgccctcggcttctcaaagtgctgggattataggcgtgagccaccgtgcccggccacattttaaagttagcccttcattctggagcaagctgggtgggtctcgagcaggaggctataatttaataacataatataatatattatattataacatgtataatataatactataattcctgttaaagaggaatgattccaatgacaatctacttgtctagaaggaaatgtcacgtaggacatgagtagtgatttacagacattgaagtggacagggaagcgtctcattctcaagaaagccaggctaactttgtgaatgaatgcacgtctcaggttttaccttcacagcagtcacatattacctccttcacccactccaggacaagaacaggcagcacacagtttacactgctgtgcatcttgtttttctttttacgtaatagattgtgacactctttccgcatcagtacataagaatttcatctttggccgggcgcggtggctcacgcctgtaatcccagcactttgggaggccgaggcgggcggatcacgaggtcaggagatcgagaccatcctggctaatgcagtaaaacctcgtctctactgaaaatacgaaaaaattagctgggcgtggtggcgggcgcctgtagtcccagctactcagcaagctgaggcaggagaatggcgtgaacccgggaggcggagcttgcagtgagccgagatcgcgccactgcactccagcctgggcaacagagcgagactccatctccaaaaaaaaaaaaaaaaaaaagaatttcatctttgtgctgagtatgttgggggtggggatcagtggagtattctgtcctattagtttatccattctgttgttgaatattgtttctatccattatattgtttctaatcgtttgtagttacaaccagcaacacaataaataatctacatctctcagatgtaacattcttaggtcaaagagtatgatttatcactgtaataagtgttgccggctcgtcctccaagagctgcatacttggacaatcatacaatagtccagcaggtagagtgctgctttctctactttagccaatggaccaggtatgagacttaaaagagttgtggccaggcacggtggctcacgcctgtaatcccagtattttaggaggccaaggcgggcggatcacctgaggtcaggagtttgaaaccagcctggccaacatggtgaaaccccgtctctactaaaatatgaaaattagccgggtgtgatggcatgcacctgtaatcccagctactcaggaggctgaggcacgagaatcacttgaacccaggaagcggaggttgcagtgagccgaaatcgcgccactgcactccaacctgggtgacagagtgagactctgtctcaaaataataataataataataataataataataataaataaaataaaagttgttgaactttcaaatctctgtcaaattgagtggtagaaaataaaatctcaaaatagttttatttgcatttcttgttataaatcaagttgaacaccttttcaatcttaagtgcctttccattttccttttcggtgaatttttcttattcttttctcatttttccattgagttatagatctttgtatcaacttgtggtctctgtatgtattagaaaaattaaccctttgcctggggtattactagcaagtgtttttctcacttaatcttctgactatatgtaaagaaacaaatttctgcacggcaaaagcaccacacaccctcacatttattaatctttaattttgtgccttctgggttttatgtttcatgttatagctccaggctataaatctctcactgattcttttagcactcaagggttatatttttgcatttaggttttaagtccatttggaatttatcctagaatcaggtatgatctacaaatccaatgtaactgttttacagatgcctaccgcttgccctctgtggttgctttaaaatatcgccacttgggccaggcgcggtggctcacatttgttatcccagctccttgggaagctgaggagggagaattgcttgaacccgggaggcggaagctgcagtgagccgagatcacgtcactgcactccagcctgggcgacagagcaagactctgtcccctgctgccaccctaaaaataaaatcgccaaatggagcacagaggatgttttagggcagtgaaaccactctgtatgctgtagtgataggtacatgtcattatacttttgtttaaatccataagatgtacaaaactaaaagggaacctgaatgtatactggactctgggtggcaatgatgtgtcaccgtagattaatcagttgtagcaaatgtaccctctggtgtggatgttgataatcggggagaccatgcagggcatacatgggaaacctctgtgcattcctttaaattttgctatgaatctaaaactgcccttaaaaaagattttaaaaaatagtgtaaactacaacattaataattttatattgactacatattgaaacagcaatattttgaatatttttgattaaacaaaatatgttgtcaaaattaaaaatatattgccacgtattatttgatattccctccttcacaaggtagaggctgattcattaagtctgtaggtcagacttcatgactcactaacgaacagaatgtgacagaagtgatgatgtgtgacttctgagaacaggtcatgcaagggattggatctctcttggatcattgctctaggggaagccagccaccatgttgggaggacactcaagcagcctggtggaggagtcccatggtgaggaactgaggccttctgtcaacaaccagccatgaactcagcatatgtgttaagtgagcatcttggaagcagatcctgcagccccagtcgtcagacagctgaagccccagccaagagcttggctgaacctcatgagagaccttgagtcagagtcaccgacctaagtcactggtaaatttctgacccacagaaactgtgtacaataatacatgtttattgtggctgcaagacactaaatttgggatgacttcttatgcagcaatagataactaatacatttcacaaaaaccatttattgaacaattcattttcctactaatttgagatgctacttttgctatacgaaattgctctttgaatttggatctttgctggattttctgctaagttccatctagttccatctatctactccattgttctgattgagacgtaaaagctttattttatgttttaatgtctggtatggtaaattctgcctaccttccttcattgatctaatctcaaaaattatgtcaccgtgattattagaattatactgtttcttcaacttttaagttctggggtacgtgtacaggatgtgcaggtttgttacataggtaaacatgtgctatggtggtttgctgcacagaccaacccatcacctaggttttaagcccagtgacctttagctattctttctgatgctctttctcctcccactctcctgacaggccccagtgtgtggtgtttccttccctgtgtccatgtgttctcattgttcagctcccacttataagtgagaacatgaggtatttgattttctgttgcctgcgttagtttgctgaggataatggcttccagttccatccatgtccctgcaaagaacataatcttgctccttttaatgactgcatagtattccatggtgtatatgtacacattttctgtatccagtctatcattgatgggcatttgggttgattccatgtctttgctattgtgaatagtgctgcagtgaacatatgcatgcatgtatatttataacagaatgatttatattttggggggtatatacccagtaatgggattgctgggtcaaatggtacttctgcttctagatctttgtggttaccttaaatttataaattaaattagagagatgaaatcttatgatgttgtagaccaggttccccaggaaacagactctgagatgaagatttgtctatggaatatttattaggttgtgctcctgggatcagcacctttgaagggcagaggcaagcaggactgggcagaaggaggggttgagttgtgatgaagcccagcagagacctcattaaaaactctgaagctggcatggtccttcatagacccactgaggcaggtgggcagagtctttgtacccatgcatcagacagtcattggagaggggctgccgtcagggagataactcatcttgggtgaggcatcccccttatgataggagcagtttctgaggcgggagtggcagccaacactcccagcagcttttgaaccaaatgccctggtccccagggtgcatctgggcaatgcgtgggcagatgtcgagtcttcctgcccaagaatacagtatgactttgcacttgaagtgtcttttgtatcccttgggactattttattttatttatttatttatttatttatttatttatttatttatttagaaatggagtctcactctgtcacccaggctggagtgtaatggtgcaatctcagctcactgcaacctccgtctcctgggttcaagcgattattatcctgcctcagccttccgagtagctgggattacaggcgtgagccaccatgcccagctaatttttgtatttttagtagagacggggtttcaccatgttggccaggctggttttgaactcctgacctcccgcgatctgcccgcctctgcctcccaaagtgctgggccttgagagtattttaaagcacttgttgtacggatcttaaacatttcctgttaggcttatttctaataactttaagttttgtgttattacgtagggtcatttcttccaactaattgtttattgtatttgatccatggaagctattgattgctacagtataactttgtactggctcttactgaattctcctattgtttgattttagatttggattgtggtcttagattttccagttatacaatcatctcacctacaaacaaaaatcagttttacatttctaatatgtgtctctttcataacaactttggctaatctcagtagaatacgagtatataattgcagtgatcatggtttccttgtcttcttcctatgttaatgggaacggaacattttacattaagcatggtgctgggttttgggttgagatagacttatgttgtcatggtaaagaaatatccttggagacttttaaacaaataaatctggagataggcttcattgctttttcagctttaccccgaatcatctcaaagataccataaacattttaaaccataaggatgcagggcttctgattaactgcagtaattctaccaatggtcctcatggaataacacaacacagacaggaagagtcagaatgctgggttctcattctgcactaccatccacaaccccactgtgggcaggtcacagccccatggctcagtttcttcctgcgagagtgagggaggagagaggtggcctccgccgctttaactgatgcctgcctagtgctgggcatcatgaaaacgatacttgttccctaaatgtatccaaaatatttatcctgatagctatgacagatatcttcacatgctgtgtaggaagtttaatgacttttgcaagcaattaaaaaaatgacaaatcctaattttggtgaaagaatgtgggatacaagaccattagcagtgatggacccttgaaggttatgtcgtttgtatttcatttctattccaatcgtgccactggccagcctggaggcaaagtgtactcccttgagcactgagatgaaaggcttctgggaagagagggggaggcatgagatcactcagcagatacgacctctggttttttactcagctcccaccactttccacatcccttccggggtctgagtatccccaagggtcccagagatgctggtggaaatttgtaaaaggacagacctgcgttttcatccatgatttattttgtttttacttactaataaatgtttgatacatgtgccagaatttggtgtgagccttgctgtcttcagcaccaggatgtgaggtgcggggagtggctggcactcagctgtctcaagcactatgagtcacactgagccccagcatcctttagacccggcatccctgagtccgagcatccttcagcaccaggatacattaatctagcatccctgagccctagcatttctgagtccaagcacccctgagccccagcatccctgagccctaacatccctgagccctagcatccctgagccccagcatccctgagccccagcatccctgagccccagcacccctgagccctaacatccctgagccctagcatccctgagccccagcatccctgagccctaacatccctgagccccagcatccctgagccctaacatccctgagccctagcatccctgagccctagcatccctgagccccagcatccctgagccccagcatccctgagccctagcatccctgagccccagcatccctgagccccagcatccctgagccctagcatccctgagccccagcatccctgagccccagcatccctgagccctagcatccctgagccccagcatccctgagccccagcatccctgagccctagcatccctgagccccagcacccctgagccccagcatccctgagttcaagcattcttgatccccagcatccctgaatccaagcaatcctgagtgcaagcatccctgagttctaacacccctgaaccctgccattactgaatccaagtattcctgaaactcagcatccttcagccgtagtccctctgagtttcagcacctgcgagccccagaatccatgagtccaagcattcctgagccccagaattccgttcaagcatccctgagtcccagcatccctaaatcccagtatcccagaatccaagcatccctgagccccaacatctctaagttaaagcatccctaagttaaagtatccctgagtccaaacatcccccgaatccctgcattcctgagctgcagcacctctgagccccagcatcccttagtacaagcatccctcagtcccagcatctgagtccaagcatccctgagttccagtactcttcaggccctgcatccctgaactcctgcatttctgagccccagtatccccaaactccaacatccctcagtcccagcatctctgaacccaagcatccaggagttcttcctttcaggattcagattcagagtctggagcaagtgcagcaatggcagagcctggtcacatgcctgcaccttgactgcaaggaagactggaatgggaacaggtgtatcttaggtttctgtggtagaaggcaggccatgccttggaagaggagaaaagagtctccagtggagtgagaggaagatgtggctgctcatgtccttgttctcagtagtgagaagggccagatcacactttcgaagtctgggtatgaagcacttccaatggatgaaacaatacactgttagcaatagcactttgaaggcccccagcctgcagctacaaagtccctccctgagccaggatgcaggactgtgctggctacgatagcacaacagcacgtccaggctgccctgcaggtctgtgacacctcagagccccacacaacaatcctcccagcacccagctgagcccacgcccacagggcagactgtttactgtgctcctactgtttccccagctgctccccagaagcttgctatttcctcagattgcaatgcagtttatcagattaaaacaacggccaaggggtttcctttcacctccttgctctagttggctgaaggaaaaaggactcagagactgaaaaacacccagagaccactgtccccacccaaagatcattctgactaagaggcctcaagccttttcccagaagcctcacgaagggcatcgtccccagatgtgctttttacctgtctcatgcctccctccctcttctccctctctcgctccatggaatttagaacactactgccagacgcactttcctaggacacgatttaatggcatactgatctttgtgatgtttctactcctaatacttaggaataagtgcatgtggggtccaacatgcagaactgtgtctccttccctgcggatgtgcatgcacctgcacacacacacacacgcacacacacatgcgtgttcatgcacaggcacagacacacacgcacacacacatgcacacagtgcatacacacacatgcatgtacacacacacacatgcgtgtatacacacacactcatacacacttggccagaggcataaaaatagtaagtaactgccgaagataccacagctggtcaatttaactggtgtctcacaaattgtaacaatatgaaaagtgtggctctttgggtagttttgctattggatagcataaggaagttacagggagaattttaatgtgtgcccctacgcatgatttctgagaaggcaacattcagaccctcggaacttttggccaaactcagcctttccacacctgctgcctgggttctccctgactacgggttgttaacaccctcccgggctcccaggcaactgtgtccatgtcagtgcatgtcagtgctctccagatctgtgttctgtctgtcccctcaaagtcggggactcctttcctaaggctgccctgacatacccttggggtcagaggagtagggaaagggctctctgatcagcctggtggagctgctctctggctcaatgtcttaataacaagaaaacctcctcaagttacagaaattcagcagaaattctaaattgttcctcaccctcactttattgtagcaaaagacccctcaaaattctgcacatttcacctggtttacatcaaatataatccacttggtgtagccctaagtgttttcattgaccccacagacacgcagtaagagctgagtgtgtgaagagcagtctctgatcttcatgcccaggcttggtacaaagtttctgacttccagggactggtcttgcagagcacagggcatgaaggcgtgctgcctgtgtctgccgtaacaagtcctcctgaaggcgttccacagccttacctgtgctaggaattacaattttacttaataaaaaacaagtgattggatgaattattaattgaatgagtgaatgatgcctgtcattatgctaaatattttacacaaaatatccatttacttccttacaaagcatctgagaaagaggccaatttgttcccattttattgattggacccagagtaattgtcgaagatgatgtggctggtcggtttaactggtgtcttaaaaattgtaacagaaatgaagtgtggctcttacggaagttttgctgtaggggcacagtatggtgagcccagtgggacagtcttctgcagaggcagacgaccccacccaaaacatgcttcaggtgacatcacacacagaagggcgaggaaagtttatgactcccgtaactgaggactctgggaagagctggccggcctctagctcgtgtaaaaaggcttggaagtagggacaagagactggcctgggtttcactgtggttaggaagtgtttgatgtagactttattattattcaggtcagaactaggaacggctgccattggaaagctggtgtgttactcacagatccctagaggaggggtccggccacgccatgggggccacctggggatgtgccagggttggtcgggatgctgaggggcagggaaagtgagaaggagcttctattgtggtttccacgataagggaggctgaggcagggtcagcaggcccaggactgcccagcttgaataattctagccctctggggacagcagttgccctgggtctggtccctgccctggggtaacaagtgtgggtggacagcggccgggagtgtgagcccacagaggaggtggcaggtgtgggctcctcctttgcacatggattgcagggtttgcacatggaaagcctgtgtggggtgggcgatggttcactatctgggaattggctgattgtgagaggagcagctccccagggtcagcagggccccagctatcagagtatcatatacagaaaatgagagacaattcatactgatggtgggctggggctagagttcctaatgggagagatttgtggggttttaatctcccactagtgccagaggagggaaacaccccccacccctggctttctcaacagctgcccagatgtggggtgaaggggaggagggagaaacatcaatgctgtcagcagctgaatatgaaagagtggggtcagactgctgctcaccacactgggggaaagagccaagtctcaggctgaatgctgaaggacctccccagttctggcaggaagcacggactcctggtctgcagaccccgagagatgtccggctgcccgtgcaccctcagccccttctgaccacctggcaggtgctgcctgcagctagctacatgctggttctgaggatctccaccagagcaggagagctggaggcatcctctagcaagccacgtgttttggatgcctgcatccacccctgaaagggacattaaaatgagggtgtccaggaagcacccaggcgttgggagtaagagcatctggaattatctttgtttccttgtggtaactgattgccatgtctattagttcatttttatgctgctataaagatactatctgagtctgggtaacgtataaacaaaagaagtttaattgactcacattctgcatggcaggggaggcctcaggaaacttacactcatggcagaaggggaagctaggaccttctttgtatggtgacaggagagagagcacaagaaaaactgccacttttaaaaccatcagatcttgtaagaactccttcaccagcatcagaaccgcatgagggaaaccactcccgtgatcgagtcacatcccaccaagtccctccttccacacgtggagattacaattcgaggtgagatttgggtggggacatagagccaaaccatatcaccatgctaatggcctggttggcacagggccgtgagtgaaggactctgtataacaggggccggtggctttcacgtgctgttaactatcactcacaataagaagtacattttcacatggcaaaccacaaaagcatgtgtacatataacggacaaagtttcatgaagcttactgtacgtgaagaattccattattttctattgtgatttattccaacttgtaaaaacacttagtcctcagtttctaaattgatttcaacaccttcagcatgaaaaaagctggactagaatactgtggatggctctgtatagagcacccttgacataagtgactcttacttagaaaaagaccccatcttacacttcgaaaggcatcgtgccagcagggatcagatgttcacctaatccatagagatggcacccaaccagataagggcatacataggcacactctttaccatgcatcctcaccagaggactcatgggctataaaagagcaagacctcaccagctcgacatgggcacctccacacaccccgtcttgctgtcacctgtgatcagcaccagccatctgccaatgaaggctgtgcccaaatcaaagactcttccttgaaagaggttgaggactgtcaggatcaggccaggacactctttgtccacacctctctcattgaattggttcattcatcctttttttcctatgcccttttctcttgatgttaaatgtcaccctgatgtgaaaactttaatctgtaacatttatatattgattaagtatgttgtcacatatggtttgcaatattgattgacctgtggtgtggcttgagcctgcatgcttgtgggtctgactactgagtaaacaggaagttctaaggacaactacctcctcgggaaccccatggaactcatggcttttgtgattgaaataacatcagtaaagtctgaccttgtggagacacacaagtgtgcgtggacctggttatgtctgacctcgcaccactcacaataggatgcaccgcatcagtgagtcagcttctgcaggctccagacgctcacatgggggatttgaaggtcctctagaaattcctgaattggagggtgtctgtgtatttttgtttttaaataattattactgttaatcctcctccccacccatatcaaagcaacagatgttaaccattgaatattaggaaaattttcaacaaggtaaaggagaaattaaattctgcaataatctcactacccagagaaatccactaagtccagtaaaggcatacttaatttcacttccttttctatcctttctctctcctctattcctccctccctccctttctttctaaaatggctatcattattaatcattatgctatgagcattttctcatattgttcttcagacatagaatttaaatagttgcatgtatcatttagatagaacgctatcacttattcatttcttattttgaggcatttaaatgatttctttataaataatattgagatgaacatcccattacataaacttttagtaatatcttccatgttcttaagatatattattagaagagaaaattactgggtcaaaccacagttattttaaattcccttggttttgtgaaatgggaaaataatacaaatgaaaaatacattgagttgggtttatgttctcagaaaataaattgtcaaaaacatctttatttaattgcactgcagtaggacagtgatgacatgggttatttttcttaataccatcaagatgggtagattttgtataggttttgaatatgttatctttatgaaacacgtttgcatcaaccagtaaaatttagaaattaccattatttttcataccgactcttagctccatgacacgtgaattatgttaaccatgttttaaaacttacgaagtaactaaaagacaaagggtccttaatgtacctaactaggagaatttatatttcctccttgggtttcagaagcttaaaaagtatcaacatggtataatggaattgcaaaatgtattatcttggaaacttttttttaaaacctcagtgttgttagcaatcactaaattgcatagatgcttcatcatttttgaaggacagttcgtatttctgatttttttataagtaaagatgcacccaaatggcttttgtctaccactcatattatcaaactgtctaacaaagattctggcagttcatcctcctacatgtatgaaactgccaagtcattatacactcactgccagtgttttttttcctaattgttaataacttaataggttataaaatggcatcttgatgtctccacctaattttctttggttactaataggtttgaattttatggggttttggccattgtattattttggcagatatctttaagctttttctctttcttacagacttgaaagagctctttatataagtatattcgctttttgttatatatgaaaaatatcttccccaatttgctaaaagtgattaccaaaattaaaacataataatcaatgctataaatgaggttgttaaatagacaataacatgacaactgtactgataaagtttggatctgtgttccagctcaaatctcatgttgaattttaatcaccagtgttggaggaggggcctggtgggaggtgattggatcagggaggtggatctctcttgaatgatttagcaccatctaccattgctactgtacagtgagtgagttctcatgagatgtggctctttaaaaggacgtggcacctccctcctctctctcttccccctgctctggccacgtaagacaaatctgcttcccctttgccttccactatgattgtcaatgtcctgaggcctccccaggagccaagcagaagccattatgctttccctacagccttcagaaccatgaggcaattggagttctcatgaatgatttagcaccatctaccattgctactgtacagtgagttctcatgagatccgattgtttaaaagtgtgtggcacctcccctctctctcttcctcctactctgcccatgtgaagtgctggctccccctttgcctttcgtcatgtttgtaagtttcctgaggcctctccagaagtggagtagatgtcagcatcatgcttcctgtatagcttgtggaacggtgagtcaattaaacctgtttgttctataaattacccagtctcaggtgtttctttatagcaatgtgagtatgaactaatacatctactacaaatccaaaagcaaacagtgaaatctcctttaattcgaccaatgaacaattactgctttcatctgttcaggttctattcaattcttgacctatgtggatatttaacatttatgtaattacagctaagcatattataacattttagtttaattcacttgaataacttgttataagtacattattttcacattgtttcatggttttcataatgtagtatctatatccaacttaagaatattttgatggtattgagaaatagaaaaacctattgcatcagccagagtccaaccaggagatagaaaacacatcggctttttttttttttaacagaataaagttaacataaagattatcgaccaggtactttagattttttaaaaggccaaagaaaggtatcacagttggggagggaaggagggaagtcactctaggcctgaagaaggagcactgtgggtctggaccccaaaccttgagtggggtgcactgcccagtgggtgccagtgactgtggttaggtgcaggaggatgctagatagagcagcagacaaatgccaaatggagtcagatgggacagctgctgctggcagagtaaagaggcattgctggaaggcactcacagggaacaggaagaatggggccatcttcctctgcctggcagagccttccagggagccagtggcaaagtgagtgtgtctgcagtcccagcatatcacagcaggtccagagagggatgacagcctgaaaacaagcacatcgatccaaggataaccagggctccctgcccccctggaaagtgtgtcaacagtagcagggcttgttttgcccttgcagaccatttactcaaaacagcctcttgggcctcagtcattcatgcctgcagcaaatattttttttttttagatggagccttgctctgtcaccaggctggagtgcaatggaatgatcttggctcactgcaacctgcacctcccaggttcaagcaattctcctgcctcagcctcccgagtagctgggattacaggtgcaccccaccacgcccagctaattttcatatttttagtagaggcagggtttcaccatgttggtcaggctggtcttgaaatcctgacctcatgatctgcctgcctcggcctcccaaagtgctgggattacaggtgtgagccaccgggcccagcctgcagcaaatatcttaataccttaatgtgcacatggtaattagttaatatcacctttcatttaaactgtgtttcacagtctcatttcattttcacacatgttcaagacaaaacaaaacaacaaatcatgacttactataaactctagtctgtatcatggactatccctggtcataccaggaaaactgacttactatttccatccaaatgttggaagtttgaaacataccaatctgttgatgttcaactatgttcagggcactaagtggaattcaattaaataagtatttattgagcccttactatgtgcacagaggtctctgtccaagcttcatttgcaaatagattcatttgacaaagatgagaagtggacatgcaaactactctaatgtaaagaaaaaggaaataaacttgtatttgaataaataaatggtgtcttcacaaatctgtggccttagtcaaaagctcttcacattctcacccaatcagatcaatccattctgcctctccacttatcaatcttatttatctataaaggtccagtaaaaacgttactatatcctgtgaacagtctagttttgaattcatagacataaaatcttagcacctgaaggatacgtagaggtctggcctcacccttagtgttactgctaagaaaagtgggtgcaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgaaccgagattgcgccactgcagtccgcagtctggcctgggcgacagagcgagaccccgtctcaaaaaaaaaaaaaaaaaaaaaaaaaagaaaagtgggtgcaattgatggacacctccgggatggccagagacaaggccaggaggagcccaggcaccctcccttctgggtaccactcctctggggcttgagctctccgtggctttgttgtacgtttaccccttgaccccctgctgagattataagctctatatggcaggaattgcgacttgggacttttgttccacctatgtggctttacatggagtaggacctcagtaaacatttttgcacagctttattgaagtataattggtgtatggtaaactgcacatacctaaagtgcacctttgatgagttttgatgtatatttatgcacctatgacatcatccccacaattaagacaatgagcatctccatcagtaaacattttttgttcattgttgtgggaagtcaggaaccccgaatggagggaccggctgaagccatgacagaagaacataaattgtgaagatttcatggacatttattagttccccaaattaataattttataatttcttatgcctgtctttattgcaatctctgaacataaattgtgaagatttcatggacacttatcacttccccaatcaatacccttgtgatttcctatgcctgtctttactttaatttcttaatcccgtcatcttcgtaagctgaggaggatgtatgtcacctcaggaccctgtgatgattgcgttaactgcacaaattgtttgtagagcatgtgtgtttgaacaatatgacatctgggcaccttgaaaaaagaacaggataacagcaatgttcagggaacaagagagacaaccttgaactctgaccgctggtgagccgggaagaacagagccatatttctcttctttcaaaagcaaatgggagaaataccgctgaattctttttctcagcaaggaacatccctaagaaagcgaatgcatccctgagggtgggcctctaaaacggcccccttgggtgcggctgtcttttatggtagagctgtagggatgaaataagccccagtctcccgtagcgctcccaggcttattaggataagtgaattcccacctaataaattttggtcagaccagttgtctgctctcaaaccctgtttcctgataagatgttatcaatgacaatggtgcccgaaacttcattagcaattttaatttcgccctggtcctgtggtcctgtgatctcaccctgcctccatttactttgtgatatcttattaccttgtgaagcatgtgatctctgtgacccacatcctattcgtacactccctcccctttggaaaatcactaataaaaacttgctgattttatggctcaaggggcaacacggaacctgccgacatgtgatgtctcccccggacacccagctttaaaatttctctcttttgtactctgtccctttatgtctcagaacagctgacacttagggaaaatagaaaagaacctacttgaaatatcatgggtgaatttcgtccagtagttcatggaatagacggcccacacatgacaatgatgaaatggtgcaagaagcccgatgtggcatctttagggagatccaagggctctggactcgtggaagctagggcattttgtgttctcacagttcgaagcacacgttttcaaatgtccttgctctgcctttgtcattccctcagtaggatgggcgtcttccagtctgaaacatcatcttagtcaccacactccaaagccctcaagtgaagcagagtagtttcacatcacacaccaattaagccacacattagttagaactagaggttgctgtgaggaccacccagcacatgttctatgaataatgtaatatatttctataaatcagtatataagcaaaaatctaaaatagttttttctattctataaacaaactaaagtatatattacgaaactcacagtgtgtacagtgtaatataatattcaaggaaaaatgttcatcagatcattcaataatttctaactcattattatttttagaaattactggtacggtcttatgtttgataagctctcatcaaactaaattttgctcatctctaagctacaattttataaaggaagctgtaccaaacccttccaatgacttctccattatctcactggtcattgggtgagtcctcaccatcacagaagggacctgtaccaaacgtttacaaagatctcactggtccttgggtgagtcctccccaccactgagaggacctgtaccaaacccttccaatgacttctccattatctcactggtccttgggtggtgagtcctccccaccacagagaggacctgtaccaaacccttccaacgacttctccattatctcactggtccttgggtgagtcctccccaccacagagaggacctgtaccaaacccttccagtgatttctccattatctcactggtccttgggtgagtcctccccaccacagagaggacctgtaccaaacccttccagtgatttctccattatctcactggtcattgggtgagtcctccccaccacagagagaacctgtaccaaacccttccaatgacttctccattatctcactggtccttgggtggtgagtcctccccaccacagagaggacttataccaaacccttccaatgacttctccattatcttactggtccttgggtgagtcctccccaccacagagaggacctgtaccaaacccttccaatgacttctccattatctcactggtccttgggtgagtcctccccaccacagagaggacctgtaccaaacccttccaatgacttctccatgatcttgctggtcatggagtctggcccatatccttactgcagcaggatggtgatgggtgggctgcccccacctcctggatgctagtgtttctcacaccacctgtgcttggagggcttgtgcttctgcccccacctacaacactgtcaccagccctgcccgctccattcttcccaccagccctgggcccctcctgagtgacatgcagatcctgcatctgtcacagctgccacctgagagtcattcaagccttggatccatcacagctgctacctcggtctacttagctcatgctgcaacatccagatgcactggtcccaagtcccagtaccaactccacaggagtgaggggtgctttctttacaagaggaaaatttggactcagacacacacacacagggagaaagccatgagagggtgaaggcagaggtcgggtgatgcatctacaaactaagagtgccacaagtggcttgacgaggtgccaggcagtctggtttgaggtgccagtggtttaggtttaattccacagcacctggggctgggcctacggacattcaatgcccatgccaggaggaagaggccactgccctgtttaggtgtaactcctgcttggagaaatgaggagaagccgcagctttctgctggatggtttccaggcagctcagactgagcccttgaggccattttcagatggttctcttcatttctggcaagtttgcagttgcagatgctattgagaaggcagaacccaaagagagaagagaaggcatgggaaggcattcagagcccatcacaacgcagctgagcagcagccagcatcctttaatggcaaacaacgcaaactgacttgggcatatcaggcatgaagacactgcaaggacgtagagaagtttgcagacttgagaggaaatctagaaaccaggtgagtaagggacaggctccagagacttctgggagtctgggtggcagaaccatgggtgggtttcccagggctctgatgcagctgggctccaactatttgggggtcatgttgttgtctctctgctagagctgcaaactgtgggaccgagcatcccattggcctagctggggccacatgccagccttggctgctgatgggaaaggattaggggtgagagctctgctgatggtgcttgatgagaaaaggataattacttcaaaggatgatctaggtcctcttaccaccgcaaaagagaatggcaaaaatgtccaatctacacctaccaatggtgagttctttagaagtctctgcatgatgtgcaccacagggatttggaagagggaaggatgcagctgacctgggggagtcacacggcctgtaagaacaaggaacttggtcaagcctgagagaaagtcgcatttgagtaggtggagaaggccgggtgaagagacataccggcaaaggctgcagcagggacgtgctgggcatgttctggggaaaaggaagaggggttgacctcagctgggagccatggtagaggccaggctccctgttctccagaggacccatgctgttgaccacgccttccttcctgaagttcgcttgttcattggctgctgtcacccatgatcttctgggtcttctcccacttttaccccgcgctttctcactctcctgaggctcttcctcctctccctgaccctcgaatgttgctgttcatatgttcacatctaatcactaatttgatggtgttaggaggtcataagggctctgccctcctgaatggaattaatgccctcctgaaagaagcctcagagagctctcttgtgccctcatcccttctgccatgtgatgatacaacaagaaggcaccatgtatggaccagaaagcaggatcttaccagatgctaaatctgctggcaccacgatcttgggcttcacagcctccaggactgtgagaaatgaacttctgcctcttctaaaccactcagtccatggtattttacgatagcagcctgaacacactaagataagggccctcctgaagctccagctatttctcaggagaagccctccatgtcaaagtctccagctcagatctccatccatgcttcagagttgcccatgcctgttgatgccccccaggctggccagctaaactcaatacattcatgtgagctcatgtcccatccccagacatgtttctcacacctctttactgacttagtggatggtgtccccttcatctagtcattcaagccccaaacccagacatcccccttgtgccccacctttgactttcctcatgctccattatggactcaccaattaatctttttgttcttccccccagtctctctggaatcaccttcttcatccacacacactgcctctgccttggttttgtctgtcatcatctgcactctgggctgctgcaatggtctcctggcccagtcttagcctattcctggtaacttcctctagctgtggtcagcatgaggttcgtgaaacaaaagcgggcttccatcatgccctgcagagggctctcagagagtctcgtacctcagggcaatccagcccctttatcgtgatacccttgtgatcaggggcctgttcatggcttttcccattcactgcttgaatgtttagccccagatggttctccaaaagtgtccttcctttcatcttgtcacgtcttcacagtcctcctacctatgctggtaataccctttccagtgcttgtagttctcagttctcctggagaagtcagcacagacatagtttccttggggtaggctttcatctttcacatacaggtgcacacactctcacacacattcacatatgcactcacacacacatctcccttgggtctgcccagtaccctgtactcagatgcagagccattctccaatgtccataattgtctatttattgcctgtgtgcacgtgaaagcacagcaatgttttgttcatctttaatactcattgcctagcatgaggtgtgacataaagggctccaataaatattaattaaaataataatgaatgaacaatagatagtgcagaagaacatcttggaaatatgccctatcttgggtcatgttaccccaggagctttctatataagttgaaaattgattggaaataggaagaaaacttagataatttagtgtccatacctgcatgattatctgtgtcagctaatgcaatggtcagccctgatgtgcactcctgcaaggagccagtggaatgaggtgacggggaactgaatgagagccttcagtccaggtaattctgatcccttcgtttccctcttcaacctctaagaaagctcttattttcattcagttgtttgtatttcatgcccggggcccaaactcatttgttcagttctgttataatttgattattgcagaaggaaaaagcacacatattcagagacagacaagagtacattgttccactgaggatcacattttggctttaaaatatccaataacaagaatgccggtgcagtattgcctacaaagaacagctgagtttggaagactaaacattaatactcactgtcaaaagatgaccaagagtagctcccaagtgagttgggatgatgaaggagacctgatgcattgagtcctgtgcaagtcagtgagtccgtcagcagccaggacagggttccacattccatctgcagagaccaatctgggctgtggtgcaaagggactgctttagcattctttctttatgttcactcatactcacataaaataaaacaaaatattatttttaagaggctaaaactaatttttaagagggtttatgtttcagtcacctgccttaaatactatttcccctgaactattttaaggcttacacaaatatggattaataggggagaaaactgcccctgcaatattccctaccagcaagtgatggggtggggaacccctgaatccccagatgcatcacccactgaatggactcctccaagaaacagcaggccccaatcatgtaatgggtaaattatttcaaatctttgaagaacagagaactcttccccctttcaaactgttacagagaatagaaagagatgggaagtaagtattcattcatttttggaagcctaatattaatgctaaaatatgaccaagattttgaaacagaaatactatttttttttgtttttgttgttgttgtttttgagacggagtctcgctctgttgcccaggctggagtgcattggtgcaatctcatctcactgcaagctccacctcccgggttcatgccattctcctgcctcagcctcccgagtaactgggactacaggtgcccaccaccacacccggctaattttttgtatttttaggagagacggggtttcaccatgttagccaggatggtctcaatctcctgacctcatgatccacccgcctcagcctcccaaagtgctgggattacaggcgtgagccaccacgcccggccaacagaaatactgttaattaatcttgctaggtaatgaggagacagagccctgaatggaatacccagtactgcgttaaaaaacaacacaatatattagtctgcccaggctgtgtcttaccttaatctgtttttgttgctgtaacagaatactagagactggattatttatgaagaaacgatgtttattggccaggcatggtggctcacaccctgtaatcccaacactttgggaggccgaggtgggtggatcacctgaggttaggagtttgagaccagcctggccaacatggtgaaatcctgtctctactaaaaatacacacacacacacacaaaattagctgggcatggtggtgggtgcctataatcccagctacttgggaggctgaggcaggagaattgcttgaatccaggaggcagagcttccagtgagccaagattgtgccactgcactccaacctgggtgatggagcaagactctgtcaaaaaatgaaagaaggaaagaaagaaagaaagaaagaaagaaagaaagagaaagaaagaaaagaaaagaaagaaagaaaagaaaagaaaagaaagaaagaaagaaagaaagaaagaaagaaagaaagaaagaaagaaagaaaggaagaaaaagagaagaaaagaaaagaaaaaagaaaagaaaagaggtttatttagctcatgggtctggaggctgtgaagtccaggaacatggtgctgacatctggtgtggaccttcctgctatatcacatggcaaaaggataagagcatgacagctcagatctcttttcctctttatgaagccaccagtccaattacgggggccaccctgatgaccttatctaatcctagtacctcccaggccccacctccaaatgccatcaacatataaatctggggattaagtttccaacacatgagacttgggggacacatttaaaccacagcaggcggccagaacaaaataccacagatggaatggcttacacaacagagatttattttcctacagttctggaggcagaaagtccaagatcaaggtgccggcaaggttggtatctcctgaggcctctctgttttgcaaacagtcaccttctcacagtgttttcatatagtcattcctctgtgcatgtgcagcctggagttcttttcctctccttataaggacatcagtcctattgggtcaggccctcacccttatgacctcatttaaccttaatcatctaaaaggccctatctccaatacagtcacattgtaggttttaacttcaatctgtgaatttttgggggaacacacaccatgttaaagtgagatttattctaagaagagaaatgttattcaatattaagaaatatattactatcattattcatattaataagttaaacctactcatacattttattttaccgagtatacatacaatggtgtagcatacaatggaattatattttgtttttttcttcatgattttatgtatatatgaaatgtatacattttatatatcatacataatatatttttatatacatctattcttggtgtctttacttttactgatttcttacaacttcagacacacagacacatgcacactgacatatgtgcatgtcagtgtgcatatgtgcatacatggtagatacatacacacacacacccctttgctcaggaaatcaaactcaatttttctgagattcatctactttgcttgaagtactaatgactaatacaaggaacttaaaaataggcagagagtgcctctagaaaaaccctcttgtaattaagggcagcaagctaagatataaaggaaacacacagtctccctctctctctctctctctctctctctctctctctctctctatatatatatatatatatatatatatacatatacacacacacatgtatgtatgtatatatacacacacatacatacgtatgtatgtatatacacacacacacacatacgtatgtatgtatatacacacacacacatacatacgtatgtatgtatatacacacacacacatacatacgtatgtatgtatatacacacacacacatacatacgtatgtatgtatatacacacacacatacatacgtatgtatgtatatatacacacacacacatacatacgtatgtatgtatatatacacacacacacatacatacgtatgtatgtatatatacacacacacacatacatacgtatgtatgtatatatacacacacacatacatacgtatgtatgtatatatacatacacacacatacatacgtatgtatgtatatatacatacacacacatacatacgtatatacatacatatatacgtatatacatacgtatatacgtatatacatatgtatatacgtatatacatacacatacatatatacatacacatacatacatgtacacatatgtatagattgataaatacggatatctatccctctatatatctatatctataattcaaagtgatcattacaatgttgactgtctctctctcagttctgttataatttgattattgcagaaggaaaaagcacacacatctagagatagacaagagtacattgttcccctgaggagcatattttggctttaaaatctccaataacaataacagtcatgaaatattgtgctgcctgagagtcatcattgtaatgatcactttgaattattttttgttctacatttacaagagtaagattactatttcaaattatttgaatattttgtgggcttttatataataaatagtctgtcccaaaattatattggtatatactactaatagtcatacataagcgtgccaatttcattgcaattccaccaaattttggtagtataatttttatttgtgcaacataacaggtatgaaactacattttatagttaaaatataggtaactatgtcctatattttaattttcaccatctgaattactagactttctatcattttccttgcattaattcacaatttgtctaggataacccagggtccccttccttttattctaccaacttttgtccctcaatacaggatacctggagcaagattttacttctgtttggtttctgctggaaaacctagtttggaactgaagaacttcagtcttaaaacatcagctgtttgcctgacctgttaaggagactattctcacctttaacttatcttggaaatctcccgcctttgttgggttcttttattgagttcatctatctaacctattcctaactccccctcccttggctcccaggccacagaatctcagagttggaagcagccataagagccacattctccagactctcagcccaagcagccatccccattgtgtgcccatggacttagtcaaccagcattggtgcaaatgaccaagatctcaaagttaagattagtcaaaaatggctttctagccattctctatgcatggaactccagtctgcttgtgtctctaggcaccctcttccttgtggacttaggatctcccattttaatgagacttcttatataaataacatttctaaagtatcagtgaagctttcaaccactaggttatcatagatatgtcctatcttccctcaaagtggctgtctctagtccattgtaataatttgtaataaataaatgtaatgggatcatctattggatagaagaactttctattgtggagatgaattattaatgcagaaatccacaagcttctaaaacctagcactggcttgggcaaaggtattgtctctatgtgaacacctttaaaaatagaaaagaaatcagtcagtgcctctcaaattgattaatgtatactaatacccattcctccagaatttatgatagtgactctgttatatgggaaaagtattactatcccataagatactgaaatgaacacctacatttatatcaaacacacttgaaataaactgctcagtagcacatcagggctgcacaggtcaatgctgcctgcggtgaggttagaccagcttccctcccaatggtggaacacatcacagatgtcaagggagaggcaggaactcaggggaagaagacctgatccagacagctcccatgtgctacagactttttcatcacatcccgcacaactcatgtccttgtctcatctttatgacctatgatgacacctgggccatatcccacaaacacaaaacactcctgactcagaagctgacggccagtgtttactcaagtggcaagaaaggctttgtgttgaaaaatcgcagaaggaagccatctccttggaggctcatgcatcgccttaacaagaagagtgttgttcatatacattttcttgatcagcccaggatcctctaatgttttttgaatgtctaacatgtaccagttcaaaggaaaaacttctagcttcagagagaaagatcagaaagaattcagaagttttctctgaaaacaggattctcagtgtcctcaccttttcaatgtcatacaacttcagacacacagacacatgcacatatgcacacacagatacacacacacacacacacacatctttgctcagaaaaatcgaactcagtttatttgagatccatctactttgcttgaactactaatgactaatgcaaggaactcagaataggcagacagtacctctagcaaagccctcttgtaatgaaagggcagcattctaagacatacatgaaacaacacagtctaactatctagtcattctctgtatgaagaacactgaccacatgttaaaactgttcctatccattcctgttcttcttggttattcaaataactttggctttaagactttttttaagtgacttaacaacttattagcttattttcctgaggctaacatgctgagcttgcaaatacaattttaaaaggagcaataattgaatgattgaatagaatattcccttctgttttatatggattgcaaagtttttggtattgaatagtagattcaatagtaaaaattaaaaattcaatattcaaaaattatatttgaatattcaaaactatcaaatagtttttaatagttttgaatattcaaatataattttcttctgtgaattaactatataaagtgttttctcttttccaaaataatgacctggtattccatattcgcttcccttctgtgatgatttctgcagaagatgacagataatggccaaattcttaccaatgctggggaggaagatatgacccatggactggtctaccattagctgtcattgtgggtttttaaaaaattaactagagatgaggtcttgctatgttgccgaagctagtctagaactcctggctgaagcaatcttcccgccttggtcttccaaagcactgagattacaggcgggaggcacttccccagccattatcactgtggttttattttgcacttttataaaggtccatctttgagttctttgctttacagaacctctagtcagtgggttttttcccctctttaaaataatacagctctctattgtatcaactgaaagtttcttcagctctaaaactatgattctgtcactaaaatgtatttttctgtccacatactgacttactcaatctcaagttacaaactgtttaatttaacagttgtcaacaggtgtatcagctcagccctgtgactggttctgtaaaagattgtgcccaagttaaacatgggactcagctcctgttagtgaattcgagaacctggcaaactctttctcactgaagaactgtgcagtattgagcactgttttaatccgtgtaaatcttccttcctcggggcttttggcataattgaacacctgcacaaggattgtcagtcaagtcatgggatgtgtaggatgtaccatgtttttatttacatgttcctatttccacttgtgtgatcctgagcatagagaaattctaatccggcagactctggaggagggaaggagggcaggaatgtttactgtggagctgctgtgaaggcagcattgcacgtctgttgtttccactaatttcatcctcatcacagtgctgtgagccagcttctccttgtttgtgtaggaggaagctgaggttcacagaagtcaaataatgggcccaaggtcacccagctagtaagtagcacagccagaatgcaaacataggcccacatccctggcgcacgccttccacctccaccagagccaggagccgtgagtgaggccaggtgcagagattggcacctgctctcagcgtctgatacgaaggagaagttgacagatcatatccctccctagcgcctccttcaatgatgggtctccaatccccagttacctctatgttaacacaattccaaaaatgtgacaattccaagaaggaagttccagttcatctttagaatgacttcctcatctgtaaagtgataatcatacagcaatatgatgatgcaaatcatgataacctggctggtgtctctctgaagctcttgggggtgccgggcattgtcctggccaggttacctccaagccttataacaataaagacaaggaaacaaagactcagaggtgtacaagaccccatggcgagtaaatgacaaagccgggtgtatgagttacctactgctgtgcaagccaccccaacctgtgagggagagaacagcggacgtgttagctctcagcattcgccacccaagaatctggagtagcttggcgggtggtcctggctcagggtctctcatgaggctcctgactcctggttcagggtcagctcattcaactggctgaggctgagggcaagtctcaaataatcggcttctaacttccctctccaaggggatgcctcactgcctggccgctgtcttccctaccatacctggcaaggaaggatgggcacaggagagtggcctagaggccagccctgcccaatactggatctggcatccaccatctatgccttattttcttcattagaagctagtaagcaagtctgagtcacactccagggaggtggtgttacaccaggtgtgcgttccagggtacaggggtgattggagctcccaaggctcccgtcatacccggcaactgtaattctgtgataaaaggttccagtcattcccaaaaagcaccctccccgcagatgagacggaaagtttcatgtgtcaaatctcttgcaaagttattgacttactttttttctttaaagatactgactttttcatcaagaaactgaattttagataagtgaggatataagtgcagagccctctggggctaaacgttgcctgaaaagttttgaaaaatagatgagccccaggaatgtggaacacctttggtctcactctaacatagccctagaaaaactgcaaactggttctgtcatgtcggaattgctagacagtcaatggtttgcacccttccatttgaaaaaagtggccaatgtagacgctttgcggcagcatcagttctgaccaaaccatcatctgagcaaatgcgcattttcttcaggctcagccttcccgctggtgtccaccaaaggaaaatccgccctggccagtgagtccttgtgtcaggagctctggggcctgtgtttccctttgcctaaaagtaggggctggcagcacggaaggcctcctcatgagctttctggagtgttttctgagcgcagaggaaataagcgaggcaaaggtttggctaagggttcacacctgtcctcttctaatctctcacccactttcatcattgtgtatgtagtcgccatcgtcttccaaagttgctataataggggtcctgtttcattctttttattttgactacgttatctaacaattctttatacttgtctcaaaatactcattttttggtgggggtgatacaggaggggggcagggaagtgctgggttgtgaaaggcaggggtcctggtgagggctccaccttcaggcctatgcccacggacctaggtgaagacaggcactcctgttttcacacccaaatgttgcatttcccaagactaccctggcctgccacaccacccccccccatcctgtgcctataaaaaccctgagaccctcgcgggcacacacacagtggctggagtcgagggggaatcaccggcagaagaacacacacacacacacacacacgccgacgggccatcgatggtggaacaacacggacactgagggaactttggctgggggcagtcggaggagagcctggcctctgagtggcctgattccagggaaagaccaccttcccactccatcccccttctggctccccaggcatctgctgagagctatctccaccattcggtaaaaccttacactcattctccaagcccacgtgtgatccaatttttccagtacactaaggaaagaaccagggatacagaaagcctctgtccttgcgataagccagagggtctaactgagctgattaacacaagacacttgcagatggctaagctgaaagtcagactgtgacacgcccactggggcttagggagctgtaaacactcaaccctagatgctgccctgaggtcggagcccaggctccccacgacctgcccgtctgcatgcttcccctaggggtttgagctgcgggcaccgaagacgggagccatacacctgtcacacgccctgcgaggggaatatgggaacttatccagtttcaggaggagggaatgactagctaccaaacaaccaaagccaattttcctgtgaaagggacgctggggcatctgattacttttgttgctataaaggccttggaggctgggcacagtgtggtgtgcttatagcctgcacaacgtggcaggatcctgtctctctaaaaacaagagggggtgctttggtgaggatggaaaattctgaatagctctgccttgatgtcttctgctgtcattacagcaaaagtggtctggggtgtcactcaaacagaaaactgtcttgtttgggacttgagaagatttttggtgccttcaccaccagaaaatgaggaagaaggagcaaataagggaggaacgccaggcactgagggccgagggccttcacggcctgcactgttctgccgagcagggctgtgcgcagctgagttgagtcacgctgcctgcgtcctgggctgtgcgcagctgagttgaatcacgctgcccgcgtcctgggctgtttacagctgagttgagtcacgctgcctgcatcctgcacgcggccctgtgctctgcatgtttgaggtaggctgctttctccacacgcatggacatctttcctatggggtgaaggctaggcttacaagccctgtcttttggatgtggacatggatcccttgcacatgtgccttccgtggcatgaagactgtcagcacctggcaggactggagcgactagtgaaacaccagacaccagcccctcagccaaggtctcgcccagcacctccttccgaaccctgccctgccccggaggctgctggctccagtgcaggcctgactgtcacgggcacctacagcataaccctgccagtgacctcgcagcagctgcagcaccaagctctccaggcagcgccctggcgcaggtgaagcagcccaggcccgcgctgcaagggagccacactccagccggcgcattggcagagagagtgctctcccaggagaggatgaagcgctgcgtgggctcagggtttcaaaaagcccaccccaggttcactcccccgaaccttgccctgaagagctccccagactcggcggtgccagattcccagggatagattttgttactcagtgctaagcttctggactctttattttttcttttacagtggtctacagatatccccataacatccctttcttattaattaattcaaataaagataaataataaactgtgtggctcagtgtggttaaatgtgtatggcatttagaggttttgatgttgtcgtagacaaatgccgcttctctcccaaattgtttccacctccactccaggcctttcttcaccccatctcctcccagccccagacccactccttgcctgagctccagggtcgatcgccctgtagagcaagtctgcccgggatgaagctgacacacgaggctcatggctcagcccgcgtgtcctcacctgctgatgcagccccaggtggcctccccaggggtgcgagccacacattagcgtgagttcgttttgtatcagctgcaacctaaagagtttcaacccatgactcagaaggaaaatgctccgatagaccacacaacccaaacttgtaggagacttgcatctggatgtcattgtcattggtatagatgaaaggacacggccctgccattgagagtggcctcacatccccctgtaggctcccgggatgtcctgagctgcacttcctacttcaccctgtccaaggctggcccgtcgtcccccagcatccaggctcacgaaggacggcggtcccctgccccctaggagggagtcagctccttgcagccactggaagcccacccagcggctcacctggactcagccccagcccccagcccacatctcagctgggatttccccttcctgcttccgaggctaggaggaccctggaaaggactctcaccctcctgctgctgcatgttctgtgtctgctttcctctttccaagccttccgtggtccctgcccccttgaagggcatattccagtgagcaaaatggacattaaatagccaacattctctttctaaagcaccagctggcccagcaatactccccgcccccggcccccaaccccgaggtggccactgcaggtgttttcgtcacgtcccaatgaggagaattttaaccaggacatcagatggctcccagtggtcttagccactgtctggttttctctcttcctgcgcccacgctgatctggactgacctcctcacttgcctgccccaaatcagaaatgactgccctgctgggcagggagctgtgattttcattttcttgggcagtgacagatgatgttgcagtttctgagaaaattaagtcatcaactcctggacgcccctgacatcatcaaaatgtctgggctggagagccacaggccctcaatttattattggaaataatggggaaaagacaagcaattacgtgttgacatcgggctctgctgctgtgaaggggtggagagctgtaattcctgcccttgggtcgtatcaagatttggaaccaggtccaatctgaaataacataaactaaaagaattgattagaccaggtgtcatttggggtgcatctctctgaactgcccctaaatccctgcaggttataatctaatgcacagtgactgcatccatttccaggggccttgcagggtggcgtggagcaggtgatggatgccccaagccttgtctggacttgccctccccagcgagacgcctcttgtttccctgtcctttctgcactgcacatcatgaggccaccatcaccagcacaggtagaagccctcaataatgaaggcagctgatcacagccagaggtgccctttaaacacccagaggcatgtcacagaggaggtgaaggctgagtctgtgaggcgacaggagaggtggagttgctgggtgccagctccggagacctgggcaaggccagtagtgccaggtaacacagacaccagcagcatccagggctgaggttctgggggtccgccagggactgggactgcttcggctcaaaggcagccaggcaggggccgggaaaaaggagcaagtggtgccctgggttactacagactttgcccacatgtctgcaggggcagggacccagtgcacacctcccggatgtccaggagcagacacagagttcagtggatgggctcctccgacaccctgagctgctcaggtgaagggagggtttgtgtgcaggtgaagcaggcccccgccaacctgacgctttgcctcgagtgtttgccttccctctcaaggctgtctcagggcactctgtgtgctctgtgtgtggggcctggtctggcatccaggcacccaggacaccagatcacatgggggacacgaggaatcacatggggctctctccacagatcctccatgttctcctccttgcccggctccagcaacctctgtcagtcaggggctgttgcccctccacccataagaaccccaggacacacctagacgtctctgggtccctacccagactttcctgtttacttacttatttacgagatactgaacccaatgtgttgccagtccccatccgtggtcctcgggacgcagtggtgaggaggacaggctccttgccctggtgggacttccatcgggtcctggggagtcagacaaacaagacaacaaaaaatgcaaacgtcagttacttagagtgacttaaaagtaaagtgaaagtggtggggagtgagagaattgcatgttactgtagagtacgtgataggagacgttcactttgtattgattttaggggcaaagaacttctatttatgtgcatattgtgtttattgcatatatgccaatttataagacatagatatctatgtgtttctgtttgtttaagcaggaaataataaacacaagaaatggcgagtcactcccagaaaaaggtaaataaatgccaaggagaggagacggatcagccctggccgtcacatgaaataaccaggtaagagaagatccttgaggtgccccaagtggtgacttcaccaagtgtcccaaagaggaaagccagcgtcgcttccaaggtgacagcattagatatccctggtagccattacataatatgtaaatttcccctaaatgctgagatagcaaaacaacagcgcagtggtcaagtcacgtcagatacttttttaaaaagagaaaaattgagcaatgcgttcttgaaaaaaacaccaagtctcaaaaattaatacataaataaagtgaaactttaaaagattcaagacaggctaggcacagtggctcacacctgtaatcccagcccttttggaggccaaggcgggtggatcatgaggtcaggagatcgagaccatcctggctaacacggtgaaaccccgtctccgctaaaaatacaaaaaattagccgggcatggtggcgggcacctgtagtcccagctacttgggaggctgaggcaggagaatggtgtgaacccaggaggcggagcttgcagtgagccgagatcacaccactgctctccagagcctgggcaacagagcgggactccatctcaaaaaaaaaaaaaaaagaaagaaaagaaaaaaagaaaaagaaaaaaaggagagagagaaaaaggattcaagacatagcaagcaacatttgagtataggcaagaagtcagccagctgactgagcaaccaggtcccacctggccccagcctagaactcacacaccaacaactcagctaacaaaggcagctttcctgaaattctgttcgtgttctgtagaatttggaaagagtcataaaatcatgggatgtgtaaaaatagaacctgatagaactcctaaaatcccaggagggcctcagtaattggatctccaggtcaaggtaagaaggaataaggacaaagaaacaaaatgcttacatttttgccatcacttttgctgtgggatgcaagtgtgtttcgcaagcattttcctgtaatgtgggctttgtcggacaccacacaaacttggagcctgggggagccctgagcagctttagcaagcttgtcctcccataaagggtcagaaagaaagtgtttatggttttgcacaactcctcggcggtcatcactattcagttgtgctgtggtggtgcgatagcacatgctcaagtggtgtgattccgttccaataagacttcacaacaaacagaggaaggcaccaaacagaagggaagggctccagggaggggacatggccgcctgtctgcagataggccgggtcaagcctgggtggaccttcacagcagtggtcacaggagtgacgttggctgctgcaggtgggagagggtagtgtggccaagtccagcccttaggcttgtaagggaccacagagggtcctgggagggacaactgacatgttgggaaattgtacctgggaactggaaatccagtctctgtgattctctggcagtctgggcactgtcacacaagagcactggtgagcagatgttctttactgggcaccggcgcccttcaggagtgtcccagagaaaccgcagaaacccacaaggatgcccacaaccaaaagacgattcaacactcacctttacagagggggaagtgagttcacactgccactctctgcaccccgttttccttatgtgccacagagaataaaccaaactcactctgtctactcccccgcctgaggttggaagttagatcaagaggttccacccctgagcccacacttgtcctgcgaagatctcgatacctctctcacggccagtgcctctgcctcctgtgcagacatgtgggcccagccacaacacagactgactccactcctcctaggacaccagactgcactgagacggttgctacctccttcctgccttcctctacttgagtcccagagaccttggctgccctccctgctctcccaatagagctccttcctctctgttaagcttggctcctggtctcccctccactggcctcttaaccaaacacaacactcagcagtagctcagccctgccctgagcctggctggaaatgtgaggggagaagaagccagtgcattcggggccctatagagacatcaaggctgacaaccagaaattcctgttgaggtgggcacagaaatttacacttacggtcaaggataggtcagtccagggtacccttactgagacgagtcctgttgaaagaatcagatgttgaaggaaatagagaatgtagaaagataaaataacttctagacaatagtttcacacaaaatcagtgtatctttgtactgacttttcaaattattttcccacccaggacagcacagaagaaagagcacgcatttttgaggcagacagacctgatttaaaatctagatttggccaccaacttgctgtgtagcctttagacaagtttcttaaacctccacacatctgcttcccctggctcagtgaaatgagagtatcaatggtatttgcttcatgcctgttttgagatccgcaaggtctcatccctgagaagcaagcaccaagagtgttctggtgaacgcgttgtcatcaccgctgcagccaccagctctcaagccagccctggatctccttgtcccgggaactgctccccctctgaatctgagcagcggcttccgaggctctgacccctctctctgctgcctgcctgctggccctagggcctcaagccgcgattcctcaaccctgctgagaccagcaagccattgatccacactgccttctcactcgccatcaaccagctcatgtctcaagattcttattaatttgaatgaaatttccagtattcaaccattttgatctacacaatggctatttgataaggctcaaaccaatcataaaaatacagcaatttgtcgtagtggctcacgcctggaatcccagcactttgggaggccgaagcaggtggatcatgaggtcaggagatcgagaccatcctggctaacacggtgaaactctgtctccgctaaaaatacaaaaaattagccgggcatggtggcgggcacctgtagtcccagctactcgggaggctgaggcaggagaatggcgtgaacgtggaaggcagagcttgcagtgagccaagatcgcgccattgcactccagcctgggtgacagagtgagactctatctcaaaaaaaaaaaaaaaaaaaaaaaaaaacagcaatttttccgagtaagtgcatcccagactcttggattcccagctcgagagtcccagaaggtgcactttgaaggcatgaaaggtgcaggcatgatgaagttgtcgtcttagcacctgcagctgccgggtctgcacagcaggaagaaggcaggccagcccttgcaggtggggccaatctcctcctagactgatgagaacttaacaaaggttttctgtgtcttggcgaccccagacacatcaacatagagtaaagagagggctggactaaaggtttgtgagcctgggttcctaatcctaattctgtcacaatcctaattagccccatgattctagaggcctctaaactgatattgtctctgttttccttttttggaacgttgtgttttgccaaccgcacactgccagtccatggcgctttctccaccacacctttctgggaacctccatgccccatcccccagagtgccaggtgtcccctctgctttgcttctgtgatttgtgaaaaccgacttcttagcaccccttcccgagaagaaaacgaacctgcgcaggaggtgacgtcaccatctggcccaagctgctggagccagcagatggaaaaatgaaaaatagaaccaaactccagggaggcagtgggggggagatgctgaccctcctggggcccagggccttcaaattgttaatcagcaggttggagacagcctggttcccatcctagatctaccgcttactctctgggtgaccttgagcaagttacctaacctctctaagactcagctctttgcctataaaatattatcataacaattcgttcttcaagagaaaaaaatgaggaaaaagtacacaggaagcagttggcacagtggccgtgtctaccacaaggggttggcatatatggtgattgtggtgggtgtgcaatgcccagtggatctcaccaccaaagtggactcctctggttaaaataattgagttaccagaagctgtgtgtgaagtgcatatatggaaaattcagccattctcaaagctgcttcaccttctcacatgagcagatgctccctgcatcgccccccaagctccttcctgagctcatgctgatttgtccactccaatcagtgacccctgaatcctcaggtgctcacagcctgcttcacaccacttagctctgaaggtgaccattttctctttctgccacatgctttggggcatatggggaagaaaaggttatgatctttctgtgtaggagctcatctaggaggagagtacaggtaacacaagaggtgtttgatatgtattcatgtcattgaaaaggaagattcctattaatagaaaaagttgtcctctgttgcctaccccccacaaatattcatttaggttttgatgtgtaaagaagggtgcaccagaccctgaaggctttaacattccaccctacaaaatacttgggaacggttacttaagatgtctacataaattgattccctaacattgttggggtcatagacctctctgagaatctaatgaaagctgtgggtcccctacctagagaaatgcacacacatgtgcgtgcgcgcacacacacacacacacagacacacacacacacaggcttcttggatgccctgaacattcctctctgaatgaaaggaacaacttcagaggcagacagacctgagcttaaattctaacacaacctttctttcaatagctgcaactctgcaagacatacttacctttgctggatctgtttccttgtttttaatatggagataatacctgcttatagggctacagtaaagatgaaataaggtaatgtctataaagcacccagcacatagtatgtgttccaacacatggtacctggtgacttcccctttaccagcaaaatatattgttccccaataagttattaggcgtgttagacatacaaagttagataaaaaaaagaaagacattaaataaaaagtttgagaattcttgctaaaaataaataaataatcttctctaccacatgttttctctgaggctttggtttaaactctcgatgtggttctacaagtgaaagaaggaggatgtagcaatttcacttatttatctgaccttagaacattgtctccatgaccatcatctggacccaatctgggaactgtggccctgatggtcagtatttccactaaactgccaacctcatggagagcagcaccaatcttattcactgtttgttagaagttaatcaacctaaagttagaggtccacacgacaatctgacttctgactttaattatataggtttggggaattccccaaaacactatcatatttgctctagaagccttcacagaactcactaaaagttgtgaaactcacagttatggtttattacaaggaaagggtatggactggaatcagccaagggaagagatacatgggatgcagcccaggagagctccaaatgcagagcttttcttgtcctcttcccacagagccaggacagcatcaatgtgtgacaataccatggagcattgccaaccagggatgctcaccaaagcctcagtgttaagggtttttgttggggtttccttgcataggtgtggctgattgcccatatagctaatctcaatctctaggatctatgacggtctgctgataccacaggactcaaagcctccaccataaatcaattgttgatgtttctgggtgtggccaacacccactctagaactatcaagtatggccatcccccaccttacaacacatttttagattttactgtgtggccaagactcccaggtgaacaaagattctctcatcaggtatgacattcaaaagttttgagctagccaggtctctttttatggcaagtgtaaattttttactgcacattgttatatcttgataaccagaacttggtggatcctcaatggtactttgttgtatggatgaataataaatatatttgtggaattatgaaaggtcttgttaaatcccaagctgcttgggctttcctgccagttctgttgtccccaaacacccacttcttatgctaattactgactcacatatctcttatataaatgtaccctaatcaatagctaagcaaacctgcaaatttcaaattcaacatcctttcatgactaaaagtctcttataatgaataaaggagaaattccctaaatctctacagaatatctaaaaaatacttaagaaaaatgtcatttacttattaaaagctttccctcagaaatcaagaattagataaatgtgcttacatcaccactcctacttaacattatactagagattctattcagtgaaataagggaagaaatggtaataaaaggcctaaaaaatgggacaaaagaagtaaaatttgtaatgtcattattcacaaatgacatcattgcacatgcagaaactccaaaagaatctatagactattagaatcaataagtgaatttagcaaggtgttatggtttaatatgtctgtcaagaagcatgtattgaaaatttaatctttaatgcaacagtgttaagaaatgggacatttaaagaggtggttaagccacgagagcagagccctcatggattaatgccattattgagggatgggtttattattgtggggtgggttctttataaaagaaagagttatctccaccccccaccctctcttgccttatgccacagaatgacacagcaagaaggccctgccagatgtcagccacttgacattggacttcttagcctccagaactgtgggaaataagatggttttctttacaagttacctagtctctggtattcttttatagcagcatgaaatggattaagaaacaaggttactaaataaaaggccatatatgataatcagttgtatttctgtatactagcaaaatgagtagaaaataaataaaatgcacacaaagcagaataagaaacttcaaatacctaggaataaatctagttaaagatatgcaaaatacatacactgaaaactacaaaacattactgaaattaaataagacccaataaatagagagatataccatgttcatggattggaagactcaatattatacatatgtcaaagctcccaatattgacttaccaactcagtgcaataccaataaaaagcctagacatttgtttgtctgtttaactcacaggctgattctaaagtgtctatggacatctaaaagaccaaaaatagtgaagtcagtcttgaagaagtagaaccaacctggagggtctgcttgaccagatgccaagacctatttcagaactgtagtgataaagacattgtggtgctgacaaaggatagtaactagactggtgactaaaatgcagagtccaggagcagaactgtgtcagttgcctatcgctgtgtgacaaacttcctcactacttatctgggtcagaaattcagaacaacaacaggggcagtccactttgctccacaatgcctggtccttccctgcaatagtccaaacatcagagaattggctggaacaactaacggcaatgatgtatctagggcttcagttcttgatgtcagtttttctcttcacttctctgggtggctaatctgggatgcctcctagcgtgatgttcccagggcagtcagacttttcatgcaacagctgctttcccctaccataaaagtggaagctaccagatgtcttgaggcctggcccacaataggaacagcagcacccacatccaagctctgttgtcaagataggctataatcctgcttggagtcagggagaagtgaaatggtgagagagccttcctgtcctgatgagtggggtgcatgtatgtgcagagtggccatctcagaagaccatctgccacagccctatatttgtgcaggcacctattttgtggcagaggtaacactacaatgcagtagagaaaagatggctttttcgataaatgatgctgggtcaaatggacatccaaaggaaaaaacaaaataaattttgacctctactttacacactattaaaaaatcaattatagaaggattgtggatctaagtataaaagatgaaatagtaatataattagaagaaagcctagggcaattcctttctgttgttggaacaggcaaatatttcttaagcaggacacacaaaatactgatcatgaaggaaaaagatgataaattgaactacattcaaattaggaacctctgattatagaaaaggaacattaagaaagaaaaaagacaagccacagagtaagggaagatattgcaacacatacagggctgatattgagaacatacatatattttaatggtctataaatcaataaggaaatggtaaggaaaccaatataaaaattgagaaataagaacttcataaaagagtatattcaaatggccaatacacatatgaaaaattgttcaacttcattagccatcagagacatgcaaattaaaaccacagtgagataccattttacaaccagcagaatggtaaaatgaaaaagacagacaaaacgtttgtgaagaatttagaacattcatccactactactgggtatgaattgctacagtcactttggaaaattgtttagcagtatctactaaggctgaacacacataaacctctgcctgagtagtttcactcctaggtgtacatccaatagcaaaatgcataaatatattcaccaaaacacatgtataggaattgcacagcagcaccatccctaataggccaaaacaggaaaaaaaaaatcaaatggttagaacaatagaatggataaataaactgtggtactgtctattcatgcaatggactattctgcagcaacacaagcaaatgaagtactgagacacaccacatcgtggatgagtcccaaagacatatgagcagaaggagccaaatatttaaaaagtacactttctattattttacttagataaagtccaaaatcaggccacaccaatctatgtttggtgtgtcctgacagacaggagaggggctgtatattagtcaggcttctcttagagagacaggcctaaaaggatagatatgtatttataaaggggagtttattaagtattaacttacatgatcacaaggtcccacaataggctgtctgcaagcttgaggagcaaggaaagccagtctgagtctcaaaactaaagaatgtggaggctgaacgtgggggctcaggcctgtaatcccagtcgtgattttttgggaggccaaggggggcggatctcaaggtcaggagattgagaccatcctggctaacacggtgaaaccctgtctatactaaaaacacaaaaaattagccaggtgtgctagctggcacctgtagtcacagctacaggagactggggcaagagaatcgcttgaacccaggaggcagaggaggttgcagtgagccaagattctgccactgcactccaggctggcaacagattgagaccgtctaaaaaaaaaaaaaaaaaaaaaaaaaaacttggagtacgatgtttgagggcaggaaaggaaacatccaccatgggagaaagttgtaggctgggaagctaggccagtctcaccctttcacatttttctgtctgctttacattcacatgaagctgattagattgtgcctaccaggttaagggtgggtcttccttccccagcccactgactcaaatgttcatctcctttggcaacacccacacagacacacccaagattaatactttgcatccttcaatgcaatcaagttgacactcagtattaaccatcaaaggctggcttgggaagggacaattacctaaaggttgcaatgcgtcttctgagctgccagagcttcttgtgtcttgagctggagctgggcatgtggtggttcattcgccatgtgacattacttgagctgaacttgtcatttgcatatttttccctgtgtgtgtgtgtgttatacttcaatcaaatttagtaaaataaaagtaaaaagctcttactcatgtatttacttgctcaaaatactccatttttcacaattacacaaattagaagagagaaaagggggaggtttgtatgtgagaccaagagagaaaggagacatagaaaaaaataaaaattagtatttttactgaaagtggtaaaactatctaagacatgaaaggaaaagaaggtaattctgcttccctggttgttattgtaattaaattaagtttttgccattagagttgggaatgtctcgttctcattatattttatatataggccatgaaatcacccttccaggacacagaagaggaagtaaattggaattatttttagttctcataaaggttctagcctcaaacagaaaaaaaggtcaagtttaatgattcctcaaagcactaaactagaaataattttttaaactcctttactgtgtcatacctaggtcactagaagacactgtattttcataagaaattgcagctactgtctatgagaactctaattttctgtacaaactgtaccagtttttttccacagaaaaattactgcacttagtagaagaaaaaaattctccctaaaaatgaattgggaaattaaagtgtaagcaacagcatgaattaaaatgaattctccaagagaaaagtagaactggattcctacctcacccaatatgtgaaggggggcttagatgaagggaaagtctacacatgaaaggtagcaatgtggagttcacagagggaagttcaggagaatatcttcatgatcttgaagggagggaaggatttcttaaacaaaacttccaagcaaaaatactgtaaggcacacgcacacacataaacgcacatacgtgcatatgattacataaaaaataatggtttctgttcaaaaaaagacatcatcggcaaactaacagaagacagaaagatattttaatcctccaaactgcaattaaaaagaagtcttgaagatcaacaagaaaaagatggtgaccccaacattaaagacgggtaaaggaggctgggcacagtggttcacgcctgtaatcccaacactttgggaggccgaggccggcagattgcttgaggccaggagttcaagaccagcctggccaacatggtgaaacccagtctctactaaaaatacaaaaattagctgggtgtggtggctcacacctgtaatcccagctattctggaggctgaggcaggagaatcgctttaacctgggaggcagaggttgcagtgagccaagatggcactactgcacggcagcatgggtgacagaggaagactctgtctcaaaaaaaaaaaaaagatccaaatccactggtttacagaagaggaaacccaaaaggacacccaggatgtgagggcgatctggttgtgacatatgtcaccccttgatccccagggtttatttggcgatctggctgactaggcgggtgtccccttcctccctcaccactccacgtacatccctcccaaagctgcacactccgttgaagaggacgaccatccccaacagaggagggccagtcttcggtcaagggtatatgaatagctgcaatcccctgctacaacctccaaacaagctcccagaaggacatctggcaaataaagaaacatgcacacaactaattatcagagaaacacgagctgaaacattgtgatatcacttcacacacttttgattggcaaaagttagtgatttggagctgccgagggctgagaggcttgtgggcagcacaggtggaagcatggctggagtggccattctgaagtatgctttgacactgcttggtcaggtagacctgcacataccctgtgacctggcagaaacactcctggggatgcacctgtggccagcgggacggcgggtcccattccaccttcgctgtcgtagattacacacccacaccctttcccctgtggctctgatgctcctcacagcatgggtggagcacacttccccaccccattgagttggaactgtccaggtgacttgctggggctggtggactcttaacaggacaagacagaggtctcaagtgtgctatgtgtttcgtcttcatctcttgcgctgcagccattcataagaacatgccctgggtagctcctggtccaaggagagtgaagagagatgggagcagaccttaacccagcccactctacccccaaccaagcccagcaggtcacctgggtgtgtctgtgagtgtgctgccagaggagactgacatttgagtgggtggactgggagaggaggatccaccttcaatgtggtgggcaccatccaatcggctgccagcgcagccggaacaaagcaggcggaagaaggtggaatcaccttacttgctgggtcttcaggcttccttctttttcccctgccagatgcttccttcagctcctcctgcccttggacatcagactccagcttctttggcctttggactcagagacctgtaccagtggcttgctgaggactctttcaggcagccttcagccacagactgaaggctacactgtcagctttcctggttttgaggcttttggactaggactgagccactaccagtttctctcttccccagcttgcagacggcctattgtgggacttcaccttttgatcccgtgggccaattttccctaataaactccttttcatatagacatgtatcttacatttctgtccctctggagaaccctgacttatactccggccaaccacagatcagtgagaaagagaagaaaatgcttgttgctgtaagtgcctcaacttagggtggcctgttacacagggcttctgcagcagtagctgactgctgagcggcatgtacaaggagatttacacagcatcacttctgctgacctggtacagtgggttgaatggtggcccccaaaaggagtgcccacccggaacctgggaatgggaccatatctggaaaaagttccttgcaccattaagtgaaggatctgaagatgaagccatcctggaccaggtgggcgctgactccaatggcaagtgtccacagatgagagaagtgggggagacgcacagacctggactattctccaagagaagcagacttctttgttcattaatccactgcattgttggtcccttttgtagcgtggtttaactttactccaactactaccttttaaagaaaaatcctgcttaaataaatgaggaacacacaggtcatggagatctggctatggaacagtgagttctagtctggagtttggactctggcatgtcccatcctgccacctgaatagtttgtccaggattcccgggacacagcttctctgagggaatcagctcagccaaggaataaaggctctctacccactctcctggtgagcccagtgagtcagagccaaggcctggggcaccactgcctgtgcactccacctgccaccctctaagcagcagttgtctctgatgtgttatgttgtgggggagtggtacagatgagaagagcttccagagcctccccacagtcacatctcacactttctcagaagtcagtaattccttgaaaggaagcctcttccttcgcattgaggatatagaacccatatactgttcactatatctttctgtattattttgttaacatttgcaacatatatccttaacttttcacacgttgcttagcgttaattttgtactacttcatgtaaaatatagaatccttgcaactgtatggctccatgtaccctgccccctccttgaatgtaactgatatgcatgccatctgcagatgttataactgggctcactgggctcaccaggagagtgggtaaagggcctctattccttggcagagctgattccctcagaggagccgtgtccccggaatcctggacaaactattcaggtggcaggatgggacacaccatatttattctacactcacaccctaagtattaagaggaaagtagtcctttcaatgtacccattgatttaatatttctgaagatcatcacctctttctaaagatctagatttccatctgggatctctttgtttttcagtttgaaaaactttctttaacatttttactaatggctaattgtcttagttttccttatttgaaaatgtctttattttattttaccttcattattgaaggtgttttgttttgtttttgagatggagtctcactttgttgcccaggctggagtgcagcggtgtgatcttggctcactgcaacctctgccccccaggttcaagagattcttctgcctcagcctccagagtagctgggactacaggcgcgcaccaccacgcctggctagtttttgtatttttagtagtgacagggtttcaccatattgaccaggctggtctcgaactcatgacctcgtgattcgcctgccttgccttcccaaagtgctgggattacaggtgtgagccactgtgcctggtcctgaaggatatttttgctgaatataaattactgggtcaaaaggatgttttttgttttgttttgttctcattttttccccttttgttcctttaaagacatggttccatcatcctctagccaccattgtttctaatgagaagtcagcaatcgtctgaatgattattccagcccacagcatatcaggaaagagaattcactggctaaagtttagcctcagtccactcaagccagcttcttgggtaggtgtaattcctcctcccttccacacgtgagcagcttcctagaacaccaagctcagcgtgtgcttctcacatcggaaacttcattcctgttgtctctgccatctctagtgctatccttccctctctctcctgtagactcccagtcccttcttccttcacacctcttcccaaacactacctcctccacaaattctttcctgaaggatagtctattgggaagcctcattgatgtgtggggtttttttgtttgttttgttttgttttgagacttccacctgcttgggtccaggcatcctcttggcagaagcagctacatttaactgaacagaaagattcatttggcacctacaaaaggcaccaggccctattaaatcagtcagagtgcatgggattgtcacagtggttccatttcattgtcacttctatggaaagatctgcttaaataatattctattgtttgaagtaaagtcaagcactcccttcccatctgtctcctgaaaagctgcaccatcacactaatgggaagaataactgtaacttgaccctttccaatgggactctcaccccactgaatgctgaaaaaccttggacattccagttcagggcctggcccctcaaccttccttgccagttatatctggttgtagctcagcctctgtaaaggagtttaggaaaactgcacaaactcagaggatatcagccccacaagaatgccttcacttcagacaccagccataagttcagggatcccatgaccaccctcaaccttgaacacttgctagaatgacctacagaactcaagagaacgctgttcttaactatgacagttttattgtagtgaaaggataataaattagaactaggcaaagccagagatgcacagagcagaatctggaaggggttgaacatgaagcttctggtcatcctttctccatggagctctagatgttgtcacctcttcccagtaaacatggaatgctgtctgccagggaagctgccctgagcctctatgtccagagtttttattggggctccagcatctactgtccatatggacagacctactgctgtctccatttcctccaggggtcagaactgaattgtcatgtcccagagccctcatcataagtcacagctacactgtccagtagccaaagcccccaggcaaacaagacacttctctccaggaagacatttcagtgacctgggggtcacctcccagtggctgagggcaaaggccaggcctctctttagccaaggttaattcttcattacacagtttttatttctccattagaagaattataaaatattttattttctttctgcttttaaaatttttctataatgaattttttacttacataattcttgttaagatgattgtgaggtggggctcacaagcaggagaaacttcttttcagtgtagccattgatttaacatttctgaagattatcacctctttctaaagatctaaatttccatctgggatctttttttttttcagtttgaaagacttcctttaatatttttactaatggccaattgtcttggttttcctcatttgaaaatgtcttttctcaaccccagctgggccactaagccacagaatgacaaggttctccctaggggaagggcctcagaggtgaagagcagagactcgagccagccacacagacccccaccaccgacctcattcaccaagaggagtgctctgtgtactgcttcatgaatggcagctagtgtccttgactgtctgattactccaaaacatttacccactctcagcctagtcaaattctactcatctctgaaggccagttcaagttcgtcctgcatcaggaaaccttctgtgactgtctcttgccacccactctcctgatgcatgtgcaatgagatagaatagatggtgggtttgtccaaataatttgcaaataagttgtcacctgacctcgcagaagtttccgacaccctgatcccatgcatggtctcactaagaatctacattcagaccaaggccaagctgggccaggtccttcctccttgtcccctaagcacctggccgggctgcaggcagcaggctgtcaacccacagcagctgacgtggaaactgagctgtgttttcctccagcatcgtcttctctcatgaagcggcatctgcagtggcatgggaggcaagcccggccccttcacgaaactagaggccacagaaagagctgctgcctctccacgccaatgccagcagctctccttgtctgaggagggatgatctggctggagatccccacgactttggatgggaggaactgtcctcagcaccgaagaggcacctgttcagttcagagcacaaagtgggaggttgcaaaagagcattagccgtactcgcccaggaggtctgagtgctgcgctaagtggcccatgggaacctgagttccgtggggttgaccatgcctggggaactgaggctaggaggggccccagtgccactgaaagaagggggcatccatttcctggcatcttggggagcctgagggtgaccacagggccaaccccacttccctgctgtgccctctgctttgggggtgctgtgtaatctggggctgaggaaatgtatgggcccaaaggaagggcaccaatgtgtccagaccacccccacacagctgctcagcccatgcgtcaggccaggtgcagaggacgtggcttggcctccagaaggtctgatgggacctttctctcatgtgtgctcccacactgggtgtccctgttggggaaacccaggcactcaccccacagcccccaccatgagagagagagagagggcccttctctatgtggcgtctgatctgcaggctccctcctgaagtctctccagaggagagctctgatgtagggatgtctgcgttgggtctatgtcaatccatagtggattttttttttttttttgagacggagtctcactttgttgcccaggctggagtgcagtggcctgatctcagctgactgcaacctccgcctcccaggttcaagcgattctcctgcctaagcctcccgagcagctgggattataggcgagcaccactacgcccagctaatttttatatttttagtagaaatggggtttcaccatgttggccaggctggtctcgaactcctgacctcgtgatccacccgcctcagcttcccaaagtgctgggattacaggcatgagccaccatgcccagcccatagtggatatttagggcaatgctgctgccagcctcaaacgacaggatgtggtcagatgaagtttgtatttgccttcttaatgaacagtcagttacttagacacttttctaagacaaagagaaatgtgactttgggtttatgactcatgtctctgaaaaggataaaatggtcatacataaatgaaatcaatacctgtaccccacctccacacaccctttttcctctctaacctctccccaaccctgaagacattagatattcaattcttgttatttccaagttccaatcccagctgccctagacaactttctgatgctgacttggatctgcctgtagggagtattgctttgtggaagggactttgagttttgtggtccccatacagtcaattcccatgttagcctaagacagccaatggcatttggtcttctgtgcccatcttgcgtgcttggctaatgtgagttgtgtctcagagacacagcgacccaccagccttgacataaatacattttatgcaggctccaggcctggcctgactggggctgctccccgaggcagtgaagggctccccaagatctcctcacaggcttttcgctgtcctgacagcactgcactgcagcctgcagcaggagtcgtgttgccacacaagttgtgaaggtgcattcagtgtcattctaattgcccagctgcaatgtggagaggctgcattaaggtaaagaccccgaattgcattaggctgctgggaatgggacttgatctctaggaaagtggttctcaacctcgaacatgcgtcagagccgtggacactgacggctgggctgccccaaggttctgactcagtaattctgggctggggcttgaaattttgcatttccaacaagtcctgccctaactgttctagggataatccagggttgatattggataatccagggttgatattgcatcatcaaggaatttgtttcattgcaaggccagtaagtatcaccagtttgtaagcagcttactatttctgtatcatctcgtatttcaggcatgagagcggaggcgcctctgcctggtgagctgaacaaaagtggatccacttctatctggacaaaggcccactgccagcttcaccttcagattttacacatcctcttcctcaactttagagtgacaacaaatgtagttcacacatatgaaccagtgagtgaacgtgtgcaatgaaaatgcgcttacatttaaaaatcaaattgcagcaggcctttctgagctgggcagaccctgtgctgggtctacgacagcacatccccctcagacgtggcccgcacgccgcacatagcccagcgaggggcgttctgcagaaacgtcagcgagctcatggctaacgtgctcagaatagacactgccagctaacttccagtcacctggctatgacacactcaagcctgtgagagtgaaccgggtttgtaaaaaccaggactagtcaaagcccattattaagttttacactttgctccctggcctaagggagtagaaatccaagcttgaagggaaaggaggggtctgatttggtgaacagagatatgaggctgaggcttctgagcacgtgggtttggggtaggggtaggggcgtgggggtactgaagatcaagaagaggctgaggacactcaagggagaaacccgggctctagagccagcccccgtgggacaggccctggctctgtgtgatcttgggcaagtcttagcctttctgtgcctcagttgcttactgtagaatgcggtaactactgctgttatgggcagggttatgtccccccaaatttatagttgaagctctaaccccccagtgtcactatacctggagatggggactctaaggaggtgattaaggttaaatgaggtcagaagggtgggaccctaacccaataagactgtggccctagaagaagatgagaagctctctctgtctgtctctctgtttctctctctgtctctctttctctctctgtgatataaaggtggccattggaaaaccaggaagagaggcctcaggagaaactaaccctgttgatcttggatttggacttggacttgatctcagacttccagggtccagaactgtgaagaaataaatgattgttaaagccacctcgtctgtgacaatcacccccccccccccccgcagcgatttggtgaactggaactgaacatacacaacaccccttcttcttccaactctccttctctgtgcattctttcactcccacccgactcccacccccaaatcttcatagaaacatctggagaatgtgctcaaatctcaaaccccggggcgggaccctgcactaccaagcgcggccactgagcggcactcacacccggcggcgcgcgctggttctcccgctccggccgcgggactggtgcgcacctgggacgcggccagagaggctgaacccctaacgttttattctgatgaatttagattgaaagatggaagctatgtacgttatttttcctttaaatggaccttcatggttccactagggcgacatgttgctgcaatggctaatcattcagcctccgaaggagacgtgcggcgactgaaacgcacgccagattttgaagaccgtaggaaaaaaaaaaaagcgagccagtcattgagactttttaaattgattacatgtggaaatgctaatgttccagcgggactggattaaacaggacattattaacatgcattccacctgtttctggttactttttaaatttggctaaatgggcattttacattacaggtgtgtgggggtgggggctgacctgtggcctcggcttctggccctgggccttcccttcctcccacttgccacgggggccgggtccgggagcagagctctgcagttagggctgctgagaggcgcaggtgcagaggacgggtgggtgcccaggcccagggcacagggtcaggggtcggaaacctgccagtctttaaaactacatttcacagaggatccatcccggccgtctatacatagggtgggtcctccgtcaatccatccagcacccactgagttcaccccatctatcctatgtataagaaaatcgcggaccgatcacgggggctcatgtctgtaatcccagcactttgggaggctaaggcaggtggatcacctgaggtctgaagttccagaccagcctggacaacatggtgataccccgtctgtactaaaaacaccaaacttagccctgcgtgatggtgcatgcctgtaatcccagctattcaggaggctgaggcaggaaaatcacttgaacccaggagacagaggttgcagtgagcagagatcacgccaccgcactccagcctgggtgacagagcgagactccatctcagaaaaaaaaaaaagtgaaaaagaaaaaaaagaaaatcacccagtgcttggcagtcaccatacagccaagacccacccatcattcaagtccaccccaggctggcttcattatttttggggaggactggaccttcatttgacttgctatttaccattgattagggcctagactttgtgaagttacatgttaatttgtagatattttgtcagtagagatgcaaatgatttcagtctggtggagaatgaaatcactgaaactactggcccccaaggccgtggttttagtttgcggtaggatattgatcactttggcctctaacttagcagacttcctttacaggggctgtgttggctgatgaaacaaaactctgtcagccactctttgaaccagttgtacaattttgccctttcccagtctgggctaagcaaatctctgatgtgttcattccagatttgtatgagagtcttatatttaactgttaagtttataaggtttactcaagtagttaactgaatcaggagagaaatttgagatgaggttgaggttaacccctggggaaatgatgtccacagcatcacagggaatggttaccctaagccggggcatgcacgtggggagggaggaaaactggaaagactctttcatccagaaagatgaaggctgagaggggaggcaggtggcatttgtgattccatagacagcgtcaaagagaggaacctaagcttgttgccaaacctgagaagtagaaacctctttcaggtgaaaagaggctgtgtgagaggagaaaggaagggagtctctgcttcaatggtgtcagaagtggaggaatctttgacagatgctggagtcagtctgtgtcccgtgtctttgaggaactagccccgtgagacacagcccctgacctcagggagcaagcaatctagcggtgtccacaaaagcaacacctgaagattaaataatacaaaatacatttcaggaaatacgtagaacatttcaagccactggtgcagacagtgggagctcagaaatcagaggaggaggtgccagtgggactggggtctgttatgttgtacagcaaaacgcaatgaagttaaggacctcgagaggagttgctgatcctgggctatccaatggagtcctaggtacagtcacatgtgtccccataagatgggcagagggaaatcagaagcaccacagaggacagacaagggtcttgaagacagaggcagagactgggggatgcagccacaaaccaaggaatctcagcagccaccaggagacaaagatagattctctccagggcctctggagggagtgggacctgctggcaccttgattccagacctcgggactgcagagcagcaagaggagacatttctgttattctcagccacctggtttgtggtgatttgttacagccaccccaggacgcgaataccttccctcacatgcctaagctgagacggttggaaccacagggcaactggacacacaccccgactctctgcgctgcacttgggctgcctcccagcatggcagtcccaatggtcagacttcacaaaggtgctagcctccaagaggacagttcccaggatggggaagcaagagccccaggcatttgaagaggaagttacccagcctcatccctcccacccctgagcaagcttcagggccagcccggcactagcggaggggaaggagcccattctccccatgagaagactacaaagcacccacccagatggggtatgtggggctgctcctctgagcactgacccccggcttccaaccgcagaccatcctcagagctcagcgggtcccttctccacatcctcaaccctacagcctagagttttcagtgcccaggaccctttcagaacaggaatgtgtggaacaagctctaaatctagagtgtaacttaacacatacataaaattgctttctttcaggtttatttttaagaagcaaatgttattaatttccggagaaggaaatgaaagaagatgctgcaatgatagtgtctgcagaacagcttcaaaatcacacaaagagacagactcatgaaggtgatattgcaaaaccagcatggcatgggggcagacactgtgctgtggaggggacagtgtggaagccacattccctgtttccttctatcctcctcccactctcttgagttgaatcaccctctagtggggcctgggcctgcttgttcacccaacgtctgatgcacagttcattgttactccttcttttaactgcatcatcctttacttataaagaatttggagaggcaaataaggtcgtattaaaaccagttggagcatgatatataatgcatggtatagccaacaagcaacagtgaatcctttgaacacactttctccagtgtgcatctggtaaggaggctaagttcttagtgggatagcgctattattaatcagaaagtttgaaggtgctttttgagaattaaccccagagctacagagttatgcatcattatcagtataccagcctatactttgttcagtgctttacaatttaataagtgcctgatttctttctcagcactatgtgaggaaggtgttaccattggttaaggatgcaacagccaaggttgaaggagactaactgcttcgccgtctgcttattctcagctgtaaacagcttgcaggaggacaatctgcattgttcgcagagaagcaaatatgacccagaggtcagagtcgcaagagcccagcaatttgtctttgctccttaatccactctgtgccatccagggagagatagtaacactgatttctgaatagtgctttgtgtgttacacagtggcttcatatccagcgcctcccccacctcctccgccctcactaggggtggattgcccctgagcagggtctgaggggcaatggatcggggtgctgcaggggctgaaagctgcaactttgcaggatgtttgtgtagtcatgacagcctcgcggaaagccttgggagcatggggcgtcctaatcatcctgacaactccgggtggagggtacaccgccgtgctccatgccatcgggacagagctgggatatgcaggccatggcgaacaagcacacagcacaaacctgtgccgcactgtccaggtcagtgcttctcatccagagaggcttcatccccctggacaagcttggccatgtctggggacagtttggattgtcccagctggggaggggtgtggagggtgctgctggcatcagtgaatgaacggagaccggggatgttactaaacatcctacaaggcacagggcagcccctgccacagagaatcaccaggcccaaagtgtcaatgaggcagaggttgaggaagcctggcataggggttttacctgttatgaacatgttaatccaccggctgatgtgaaacagatgccaggatcagtccccactttgcaattgaaaacagaaaaagcaggggtctcagtccttgtatgaaacaaggtagtttttcagccaaacaaaaaacattaaatgaaataaagtcaaggtactttgaatcattttgcctcataatttataaaaaaaattagcagtaatgaatatcaacagactaagtattgtaaaagaggctttcaaaaagcagaaattacagagaagacaaagaaaataggcaaaaacacatggcttataggagattttgttcatttcttttgctttgtgttaccctcttcccatggtcctgccttccttgggttatttgaatatattttttattccattttaaataatccattgtcctttctggctatatctttttgtatcagtttattagtagtttctctagggattacaatacatatatttaacattttatagtccacttagagttcatatcttaccatttcaagtatattatagaaggcttatgactctattggttcatttatcctcctctccttatgttataattgtcatatgtaccacatctcagtaataattatacccagaaaatgttacaatatttgctttcaacagtcatatacattttaaataatttaaaaagagaaaaagaattcattatatttaccagatatttatcatttctgttgctctaatgccattcctgaagttccaagtgttcctccagatcatcttcctttttcctgaagaacttggctaagcatttcttttataggtctgttagtgacaaattctcttactttctcttaatctgagtatgtccttatttcactgtcatttctaagatatttttgctggatatagaattctgggttgacaattattttctttcagtaatttatagatgttgttccaccatcttcctgcttcctattttctgatgagaaatttgcagttatccaaagtactcttctctgatacatagtatactgtttttatctggttgcttttaattgtctttcctttacctttgattttcatttacaatgcattttttttaagtttatcttgtttagagtttgttaaccttcttgaacctatatatatatacgtttttcatcaagtctgggaagtttacaaccattatttcttcaatatttttctgcaccagtgtcctcctcctcttcttctgagactccaataataagagtattagactttttgatattgtctcacaggtgcttgaggctctgtttttgtttcatttttttttctctcaatcttcaggctgtgtaattcctattgattaatcttcaagttcactgacaatttccaggatatctcccacaatttttggcattcagggctctcctttcctggttcttctggacagaaagatagtgttatctccaagatttagcttcccgcactgccatgcagctctgcgtgactaggactaccttaggaataaattggtaaaagaaaagacaaaaaaattaacagggattatccccccatttttaaaacagctggagctctttttccagttttcttctgtccagaaaatcaggtttttcttagctttttaattctttgtgctattgtatagttccacatgactggggccatctttggagccaagtggcaacagtaaagaggaagaaataaacagggattcaccccactccatttccagttcctctggttggagagttgggtctttcatcaaagtttcagggcttccagcaccaggaccagcagcatagtggtgcagctccacagctggagctggccttgggtcagggtcaagagaggaaagaaaaagaatagtgaaaatttctcccacactccctggcacgcaggggtcccttttcctggtcctttggctggaaagagaggttttatcccagatttttgtcttctgggcccactgcacagttctgagattcaacccaccctcaggtcagagctaagagacaaagaaagaggaacaaggcaaaactcacccccatttggggtcattatcaagttttgacatcagttgcccatccttttgtcgttacttactttttagagggctcagggagttgttctttatgttcctcccagagttttcagcgttcccagtgggacggtagacggaagtgcacgtattccaccttggctggtaccagtggtcacttatagaaaatgcaaattctctcagcccaggttggagcaaatgtacaaaagaaagtaatgatataaaagaccaaaatgacatgatcaatttagtatacctgagggatatctactaaactttaaatcctaaaaatatagactatattgtctttccaagtgaccatgggacacttccaaaattaactaataaaccacacaaataacttcaattagttctaaagaggagagataatgcagaaaacattttctaatcacaatgcaatgaaactagaaattgataagaaagtcacaaaaccaaaaaggccttgacctagaaatcgtatgattccttattaaccaacttttgagtcagagggaaatacaaagtgaattatagaatttcagggaaacaacaatagtgaaaacattaaatgttagagttgagaatataaatacagtagttgatagacttaaatatccatatcaggtatagatatttaacaacactgcactccttacttcctgtcctaggtctgacttccacggtcttgctggacacagaccctttgtggacatttgacaatgtctggagacattggagtgacatcttgttattgcatacttaatagactacagtatagtataaacataaatttatatgcactgggaaaccaaaaattttatgtgactcactgtattgccgtattcactttattgaggtggtctagaacccaacccacaatatctccaaggccagcctgtatgtgatctcatttactctttataaagacatctggcgacgaaaaatctcagaactctttcacagataagaaaacttaggctaagacagatgtagggagaagagtgaaaatccccaaaccaccttccccattttttccttccccagggctcaccccgaatcactcagtgctgtgtcacgtgtcatccggacgtttttccttgagtgacaggcatgactacgcaggaaggcagaggatcgctgtgggccggaggcctgacccaccctcagaaatggtggccaagcccctcagggccacttcgtacagcaaccctgtcaccatgctcaccggaaactggtctgatcagtcctcgtgacagcagagcaggaagagagctggaggttcatcaggagtcacccaacacgtcacagaccgggacatggaagccaagagaggtgtggttatcctcatcacagttgacgatgatcctcagtgctggccaccaggatcaaactagccaccattgcctgagttctgcgtgcagctggtctgcagcgctgccccacatgggaccctctccttgaggggcacatgaccttgggcagagcagctctcttgcgatgaggcgatgagggcctcagcccgaggcggatatgggccccacaccccagtgttcaccacagccaccaggatgctcactttaacccggcggtcactgaattgaacaaggcacaggtgacccctctttgcgagtgacctccaatccaagcatcctgcagctgacccaagtcctcaccctggaactcttccataagtgtcggataactcttattgctgactggttttagctcaagaccctttgagttttaggaccttccacaaaacactttgcaaatatagctcgtgagcattgaaaaacagccccttcccccaccaatcccacgataagggagcctgagagtcagatctcatctcaaccaaggctgtgctctgaatcacccaggaaattccccactgacattcacatgcaatagatgggggtggtggaggcgtctgtgtgtgttgtttttaagcatctcaagttgattaatgtatagccaggttgggaattactgctctagtggaaaacttactaggcatagaagcagaaaacgaggatgtgtggaaacctgagggagcaggacagcttccttagcctaagtgtctttatccatcaagcatagttgatagaacaaagcaggttcacagacacactccaggatgctggaggctgggtacgggcccaccccttaaagacagcgcagtgccaacttttcccaattcacagcaggggaagttagtggatagaattgcccaattttaacttttggttccttttctctcataatcttttcttggccttgacatcttctaaaactcctctttctaagccaatgaccaacaacactgccattgtcccagtgaaggctgcctttcccatggctgagaagccaggcgagccagaggcatgggttctttgctccctgatctcagggctggtgcaggctctgcacggcaaggtgctgacaaggcctggcaaacaggtgctcagtgcctttccggctggaatcttatgctttgtcaggtgagtgctcagcaaaaagtgaagcaaattgggtccccgccattctgtgccagtgatgtagttttcagacgttgaccttccgggtctgtgctgatgacccctcatggtgatcatgaacttctccctagacctccgtgtgaggaccctctggaaatctctcaccacacctttcaactttagcccatcactgaaatgatcacatactgcttatgaagacgttgggacttggagatgcgttgatgtgcacatagcccaacttcaaattcaggctatagcatccctggaggtaaatattgatttggcatttcagttctatcaatatttacctcttaagtcaataaagcttgatgtttatctcaactgacattgatatctgcttaaagtgtatttctcacttccttcccttcttcaaatagctggagaagagcttgtgttgggcaggtcagagggaatggccgatggacccgctggtatggaatgagtcctgagactctcatttcctctctgggcctcagtatcccagtgaagcagctacgtcgtctggggtagatcccctggggcttgttgtcgcctgccaggaaaatttaggacagggacactaaagaggagtataggagtggaggtttaatagggggaaaagagaaagagaaacagcttcctctgtagaggaaggggtctccaagcagaaaggacgcactggtggtgaatgcactgtgttttatagtccagtttgaggaggcagtgtctgatttacgtagggctcacagattggttcgatcaggtatgaggtttacacagtgcgtggggaaggctgctcttattatgcaaatgggttttccagttgataggggccatcttgtctgctccttacagaacacgtggctggcagagaagtaaaggtggagctgccatcttgaaaatgtctagctctgactgggctcggtggctcacacctgtaatcccagcactttgggaggccgaggtgggcagatcacctgaggtcaggacttcaagaccagcctggccaacatggtgaaaccccatctctactaaaaatataaaatttagcagggcatggtggcagatgcctgcaatcccagctactcgggaggctgaggcaggagaattgcttgaaccccggaggtggaggttgcagtaagccaagatcgcaccactgaactccagcctgggcaacagagcaagactccatctctaaataaatgaataaataaataaatagatagatagataaatgaaaatgtctagtctttagttcctgccagcattcacccgtgcaagctcccagcttgcaggctgctctttgttagaaaatgatttggggctgcttttcgttaaaaaggaaagccttatggaggactcccatacccttgctatctgcctaagtaattccttcttaactcctggatctctaggttgtttcggagaccacttcgctgctgacatctcatggctccgctgttgcatattcagaaggacagagcaggcgggcggcctcaggtttgcaagtggcaaaacctgaaaaataaaacactgttttttattctgattgactttttaaaaagtgctgatttcagctggtactgcttggaagcaaatttctggggaaagtaaagtcataaaaacaatcagacagccttaaaactgggaccatgaagatggggtcccatcaaagaatcctggctcctatggttgaggctcagcggagggagcagtaagttccctgcaacgtctccaagcctacagcccgaggcctctcggacccgacaccctggcggacagctgcagaggggcagccccaccacgcctgccttgctcagaggcaccccgggaccagcatcagctagcagagctgggaggtcactcaggccaaatgctggcaatttcatggagaacccacagtgacagaacttccacagaggactgtccttgagatggtaaaatcagtgaaatggagtcagtaaaaccgagcacacgaggcctggtgcctgggagtgggaggagcccaggcagccttcaccagtgtgttggttcattctaacgtgtcaactcgactgggccacaggatgcccagatatttggttaaacattattctgggtgtgtctggatgagattagcatttgaatcggtggattgagcaaagcaggtggtcctccctgtatggctgggcctcttccaagcagctgggggcctgaaaagaacaaaaagcactggtcagggagaaggccctctctgcccgttttcaagccgggctggcagtcttctgcactcagactggaacttacgctagtggttcgcccaggcctccagcttgccaactgctgatttttggacttgtcagcctccacctccatagcagcatgaaaaattcctcatcatcaatctctctatgcatatatcctatatatccttttggttttatttctctggggacccctagcacaccaggcaaggtgagaggcccttgaggaggaccggctgtggctcgctggtctaaagctctaagctcctactgctgctgactccagctctgcagaagatacagtggtgacatctcctggctgccaaaaagacgggtgagtgtgagcctggggctctcagatggctgcaaagatcagggtatccagggtgttatgtaagcaggcagcttcccctgcagtctgtgctctaggctcaaagcacaagggccacaaagaagcccagcccaggatcctgtctgcccggtgagctgggcaaggtgagcatgcctgaggagtcatggccgagcacgcagcactgagcacagatcctggagggagagggatgaccctcagcccctgccctccgggacctcatggtacaggtgagggagggtgggtgctcaggttggagtcagtgcagctgaggaaatctgcatgtgccccttgatggcagagggccccgggatgcttcccctctctcagcccccactggaacgcagccgcaccttccccagaggacgccaggtagactcagtggccagaggttagggggattctgcacaggcggctcagggtgtgctggcacataccaccctcgccagggcccagggcccttgaacgccccagtgttcagtgctggccttgaaccagggatggccttcgggtgagtgctgtggggctgagtgagcctgaaggaggaccctcgggtgagaagaggcttctgggaggagcaggagagagaggaggggatttgggagagagggggaggggaagggacagggagggaagacagacagcccagctgagtggggaggagacacagggtggaaggctgggggttgcccttgaggtttggagtctgagtctggatcagggttctgctgctggtgggtgaccctgctgctggctcagccccaatcgggggcctggctgcctcactcagatgaggggccgggcttccctctcctgctttccagtgcttggactgtggcagccaccacacccacaagggagttggtggttgattcccaagggtcctcatggtggagttccccctccctgctctcccttggccctgtgggtgcatttcctggcctagggctttgtggagtgaacagtggctcctcctgcttttgtgggcccctagccagtgaggtgaggccagacctcctgaggggagggtcccatgtccccagagtcaggggtcggggtcaggggttgaggtcagtgggtcaggtgggtacattgcagtcagcatgtactcaggactgcctgtgacccagaaaaggctttctcaggcctattcccacccgcaccagcctggagagagctctgtcaggctgaggtggaattttccggagccccgggggctgtgcaggtgcgggagggagagtctgtcaggctgaggtggaattttccagagccctgggaggaggattcccagcatcaggtgagcggtgacttctgacgcactgtggaagctacaggcagggctgagtcggcggcaaggagcaggacctcctgttagaaagtcccagaaagaaacaaaccctcggggaccacccagaaggccaggatcatccgaggggccgccccgtggggtctccatggctgcacgtgcatcctgaggcccaagtcctcctcacagtggcttcactgggtgctgggactctgcagggaccgagctgttggtgctccagcattcagggagctcctgccttggggtggacagacagcaggtaaagaagcctcatgcagggcagcaggggataccctgggaaggaaagtgaggcaggaaacagacactgggccagtggctcctggtgaagggatgggcactcggggatctcggggagggtccaggtgaggacagcaagggcagaggagcctgtgggaggggtaagcacgagggaggccgaggccctgagatgtgaggcccgcatcctgctgcaggcgctctgcctccagcaagaggtggctctgggggacagctctccatgggggacagctctccatgggcttggacacccgtgctcccagacaacagcttctgccgtgctcccagatgagagccagagccctgcctatcgggaggccacactcatgcccaagacttctaggcctcagcagtgctcccaagggtgtggcaccaggtgaagcagggcaggtgtgtggaccaggtgtgctgggggggcagagggagggcagcaccccgtgggccagctacctcttgtgtgggcacacagcacctgtgcactcaaggtcacccatgtgcacgccgcctctccactcctggcagcagccaccctcgcaccatgtggctctgtgtcctggctccacagggctccctgctgctgccaggagcaattcctggagtccagcatgtggaggtagcagggcctctgctggctttgggactggaccagcagcactgcaggtgccctggctctcccacctgggcacacctgaggcctctcgcccttatctcccagggccctagcggttcccctccaccatcccatcccaaagcctcacctttccagtgtagccccaggccccagagcaggtgtatccactttattgtacacacagcatttgactcagagcccaagacatgtatctgataggaatagggctgctctggatgagggagggggtgcccagccccccagcctggctccccagcacgcccactgccctggctctgcggagcaccttccagaccatatcagaagccctcagggaggcccctggaccctgacatccccgagaccccctgagggacccactttgctagctgcatgtctgtgtcacacggaactgtctccatgctctgcaagcaggtggaatgcaggagcaggcaggaaaacccagctcttccaagtcagacactggagagctctgcagacacgaagacaatgccatgcctccccctaaatgctttttgttttggaaaatatagctgttcgtcataaggtatttacgttgacgtatgacaggtttatgattgttttaatgaattaataggtattttaaatgctcttagtttcgatttctagtgtttctcattggtgatttctaacgtggcatcgtggctgcattcaacccccataaacgcatgctccgtggtggcctccatagctcttcagacccaatgtgtgagtcccgggctccagatcgtgtctcagcccctccctgctccctcagccaatagcctgtgtccgtgtggcccctcccccgagcttcccagtgacggaggaaggcagacgccgcgtgctttccaggcgctgtcctaagccctttgcagatatggagccacttgaccctcctataacgcgtgcagtgggtcctattacccccccatttacggaccaagggcagggaggtggagacactggctggaggccgcgcagcagggaagtggcagtcaggaggcagcccaggccctcccatccgacttcagaggccagacgcacgccttctagacgctgactcacaagccaagtcactccttcctgacactcacgccaccatgtcctccccaaagtgcatttgcattttaacagccatcttccgtgagctgactctgtggttttcagtcagtggtttccagtcggctatttgtcataaggtatttacgctgacgtataacaggattatgagtgttttaatgaattaataggtattttaaatgctatttaaatgtactacctcaaaaggctgagaaatgtggggcctctgtgtggatgtgtcagtgtgtgtgtctctgtgtgtgtcagcgtgtgtgtctgtatcagtgtgtgtgtctgtgtgagagtgcgagagtgtgtgtccgtgagagtgtgtcagtgtacgtgagtctgtgtgtcgtgagtgtgtctgtgtgtgcccgcgtgtcagtgtgtctgtgtgtgtcagtgtgtgtgagtggtcgagagtgtgtccgtatgtgaatgtgtcagtgtttgtgtgtgtgtgtcagtgtgacagagtgtgtgtgtttgtgcctgtgtgtcagtgtgtctgtgtgtgtcattgtgtgtttctgtgtgtgagaaagtgtgtgtccgtgtgtgttagtgtctgtgtgtgtgtgtgtgagtgtgtgtgtgcacgcatacacacgcatataactctgctgtggcttctataacaaagtaccgtggaccgagcagcttgaacaacagaaactcccttccccgcagtcctgaggtccggaaatctgagatcacggcgtgggcagggctggttcctcctcaggcccctccgtggcctgcagacgccatcctctccctgtgtcctcacgtggtcatccctctgtcagcgtctgcttcccaactttttcttcttagtccgttctcacctggctataaagaagtccctgaggctgggtaatttatgaagaaaagcgctttaattggctcagggatctgcaggctgtacgggaagcgtgacgtcatctgtctctggggtggcctcaggaaacgtccagtcatggcggaagaagaaggggaagccagctcatcacagggggaagcaggagtgagaaagaggaggggggatgtgtcacacacttttaaaagaccaggactcctgtgaacccagggctcgagctcacttatcaccaagaggctagcccagccattcatgagggatccacccccatgatccaaacacctccctccaatccccacctccaacactgaggatcacatttccacatgagatctgggcagggacaaatacccaaactgcatcctaaagacaccggtcagattagattagggcccactccaaagccctcatcttagtttagttacctcttgaaagaccctgtttccaaatacagccacattctgaggtcctgggggttaagacttcaacatatggatttgggggatacaacaaacgccatttgggggtcacagtgactgagggtgctcctggattttgttggggtgatggttgagcaaggttgctattcacccttcagtaggtaggacacccccccaagggatatctacccagcaaaacgccaacagtgtgctctctcaggaagacttcctgaaaacaaagagccaggtagaatctcagcacacggcaggtcgctggttgatgttttcaagaagcagctttgggggtttcctcaaatccatccaatgagattccatctcttttatctgagcatctaggatgttcaaggagaaacggctccgctttttcctgcttctccaggaatccagcttagtgggtttacctgcctctgtccaaggtgctccgttgtgagtagcccctgcctctgggtgtgcaggtgatttggggactgagagctgaggcgctaaagttaaaatggcttaacgtgtgtgactgtgtgtgaatgtgtgtgtgtacgcgtgtgtgcgtgcgtgtgtgtgtctgtgtgtgggaatgggtgtgagtgtgtatgagtgtgtgtgggaatgggtgtgtgtgggagtgcatgtgtgtgggaatgtgtgggggaatgggtgtgtgtgggaatgggtgtgcgtacgtgtgtgtgtggaaatcggtgtgtgtgtcttgtgtgggaatgggtgtgtgtgtgggaatgggtgtgtgtgttacagtgtgtgagtgtgtgtgtgtgggaatgggtgtgagtgtgtgggaatgtgagtgtgtgtgtgggaatgggtgtgagactgtatgagtgtgtgtgggaatgtgtgtgtgggaatgtgagtgtgtgtgggaatgggtatgtgggaatgggtgtgagtgtgtgggaacgtgagtgtgtgggaatgggtgtggggggaatgtgagtgtgggcatgtgagtgtgtgagtgggaatgggtgtgagtgtgtgtgtgggaacatgagtgtgtgggaatgggtgtgaggggggaatgtgagtgtgggcatgtgagtgtgtgagtgggaatgggtgtgagtgtgggtatgagtgtgtctgtgtgtggggaatgagtgtgtctgtggggaatgggtgtgagtgtgtgtgtatgactctgtgtgtgggaatgggtgtgagtgtgtggggggaatgtgagtgtgtgggaatgggtgtgtgtgtatgagtgtgtctgtgtgtggggaatgggtgtgtgtctgtgtgtgtgggaatgggtgtgagagtgtgtgtgtgtctgtgggggaatgggtgtgtgtgtgtgtgggaatgggcctgagtgtgtctgtgtgtggggggagggaatgggtgtgtggggggaatgggtgtgtgtgtgtctgtgtgtgggggaataggtatgagtgtgtatgtgtgggggggaatgggtgtgtgtgtgtgtgtaggaatgggtgtgtgggggaatgtgagtgtgtgtgggaatgggtgtgtgtgggaatgggtgtgtgggaatgggtgtgtgtgtgggaatgggtgtgagtgtgtgtgggaattgtgtggggatgggtgtgagtgtgtgtgggggaatgtgtgtgggaatgtgtgtgtggggatgggtgtgagtgtgtgtgggggaatgtgtgtgggaatgtgtgtgtgggaatgggtgtgagtgtgtgggaatgtatgtgggaatgggtgtgtgtgggggaatgggtgtgtgtgggaatgtgtgtgtgggaatgggtgtgagtgtgtgtgggaatgtgagtgtgtgtggggaatgggtgtgtggggggaatgtgtgtgtgggaatgggtgtgtgtgtatgagtgtgtctgtgtgggaatgggtgtgagtggggaatgtgagtgtgtgtgggaatatgtgtgtgtgtatgagtgtgtctgtgtgtgggaatgggtgtgagtgtgtgagaggctctttctcaagactgtaggagtgggggcttctccatggggacactttcaaaggaggaagaaagaacaaaggaagaagggtggatttcactcctttccttggaaatgagtcatgactgaacaatgaatttggggaaattttattgaatttcatgccacggccttggtgcaggcaccacatgatctactacattcggggcacataggtgacgccccccagctgtgagggcaggtgccccgagactgggtgtgtgctgggcattcctggcaggcgtcacgtcccctttggcggcagattgctcctgtggggcactctccaccgccttcatgggccacggtgaatgccagccgtgacatcggggcaagctgcccatcgaggaagccgagtcggctgtctgctgacctggcagccatgcctgctggtgcttcactccctgcgagcaaggggcttagggactgctctaaagattggggtcagaatcccagaccccaggaccccccatcctggcccgtcctcagggagagctgccaacagggtccccacccgttccttcctctgctttctttccacacttggagccagctttcttttttgttgttacaaaacctgtattgaagaacaacagactctaagacagaggtccctcaatgtcatcaccaaccccatccgtgttggcgtcggccctgtgcctcctgttcctgcccgtgtgcatgttcatttttacagatttataatgacaagagagggtattgtcctctcttccctaagtttatgccacgtggaccttctcattttcgctggtgccttcctttctcaggaacctctttcccccgctcccttccccctaccctgctccattcccacccctcccccgcaccctgcacacacctttcatgcccctgctcctatgagcaaacacagcatgcgtggggagggtcttcactacggcttctcctccgcagcttgcttaattgctccgtggtaatcaggaccatctcccagtttgggaaccggattccttctgggaggtgggggagctggaggggtaggagcctcagaggagctggagtcctgctgagacgccccacccccatcaccatcatctctcccccatcttattagcaggttcctgcccctgcacttggcggtgtctacccaagctgcctgagccggccatgtgagcagcgcctccagtaccgccacagtgaaagggaggccgagcatcctggagcccatgaacccacacagcccccataagctgcccaacatcttctggtggtttctgttcaaccccagagactcttggagtttaccttaacactgtcaccttcccaaactccatggaggaggggctgagcctcttagcatcttctgggacggccccttcctcatgggggtgggtggtgagggcggtgcagggggagactaggagggctcctgcatctcctggtccctctgtggataaatacacggccagtgccccaggcctgggtccatatgaacactctccctcccccaccaccaggaaaagcagtcacagctacaggtgggcatcctcccctcctccccactgtgctcccaggcacctgctggctgtgctatgctctgcaacacagggctgccggccagggtggggccacagttagtctcattccacctgtgccgtctctgactcactgcactgtccgagtgggcagaaggtaggtgccggctccagggccaggggacacttagcaactgctcagaatctcccaaaggtggcttttcctcaaggtaccatctccttcctcctttcaccagctctcccaaaaacaggtgtgagaactagtcccttgatgtgagagatactgtgaagttcttgctttattttaaaccccagcttaatcagatgatttttcttgtgggctaagcactttcatcctttgcctccttgagaaaattgtcaaagctgaaggtctccttgccaatgaatcaatttctgcctctagcaccttttccctctttcacttccattgtgcaaataaccagttcatgctctgggtcggttggctgagcagacaggcaggtggcacctgcacaggtaagtggttgggatgaaagtcaggtccttttttctccctccacaaccagaaccccaattaacctggtacccacaagttcccgccctggctagcgccctccaactgggcccattttgcattcaatgcgattccaaaaacaaaaaaaagtgtttcacgtaagcccttaagatacaacaagagtagggcagaattttaatactggttttgctttaagacgcaagtaagtctcttttgggagccagcatgaagtgggggcaccaccactatccaactgcagatggggttggctccaggcaacaggtggatgctggacggggaaaccaggaaaggctgggccctacaaggagcccaccatgacctgcaaaggccaaggaggccaagcactcaggaactgcaggaagacaggctgtaggggacatcaggagaactaagtgtcttagtctgttttgtgtttctataacagaacaccacagactgggccgtttataaagaaaaatttattttgcgcagttctggaggttgggaagtccaaagtcgagtggccgtatccggtgagagccctcctgcagcatcatcccatgacggaaggtgtcccatggtgagagagcacgtataccagctcaggtctcccttccttttctcataaggccacatcccccatcgggtcccatcctgatgtcctcatctaatcctagttacctcccaaaggccccacctccaatcaacatgtgactatggggagtaagtttccagcctatgaaactgggggacacattcaaaccacagcaccaagcaagctggagcagccaagaggaagccacatgttcctgcagggcagggcagcctccaccatgcagggctgggacaggccagggcagtgagggctcatgggggccgcacccacgccagctcctgcagcaccagcctctggccagctgtgtgcctggagcagaggggagcaggacccacgtcccagtcccccacatcccagatctcaccgaagagatcaactagcctagggccaggccagtaggagaggaccttgtccattttctccatgaaaagtcaacatttatctctccaagtacaagtcacttcctaatcttgagatgtgtggaaacaagctctttatgctgaaaatcaacttctacattttagttctgagatgtgattctgccagccatggtggacgaggaggatggtagggacttagctagagtagcacgtcctcactagacaggggtgggtggtgtggggaggtggggggcttggccttagcctgagtgtgacgttcagcctgcatcttgagcacagtgagagcctgagccactgcaccactgaagatgcttagaagagagaccacagcaggcgaggaggcttcccaggggtctgcgctgacaaaccagggatgagggtggccagctgtgcatgagccccccagcgcccatgcaggcgtccccaccttcaccacctaagtgtggtcacgcacccagggagagctttcaacctggctctctcaagtgtgtttctaaacactagagccaggaatcctgtcctgtgggtccctgaaacataaccggtgagcccaagatctcctcggagaaacaaggctccccttagggagggcccaggaacgtgggggcctctgtgaggcagagggtcccagagggtatgaccgtttctgcagaatggtggccactctgcagaaacaaaatcacagcccaggaagagctgccaaagtgggggccaggggagccggagagggggactgagccagatgcctgcagagccgtggctcacagcctctaggaggtacgcccatgaatgtttcagaacacatttgaggactgacgtatgtgaccaactttttcttttgttaagcaaggatttttaatcaccattactggattaaagaaaaaacattttggctgggtgcagtggctcacacctttaatcctagcactttgggaggctgaggcaggcggatcacttgaggtcaggagtttgagaccagcctaagcaacatggcgaaatgccatctctactaaaaatacaaaaattagccaggcctgatgacacgcacctgtacacctgtagtcccagctacctgggaggctgaggcatgagaattgcttgaacctggggaggcggaggttgcagtgagatgagatggtgccactgcactccagcctgggtgacagagtgagactccatctcaaaataaataaataaatgacattttaataccacaattaggataatttcagaataaaaattttttttctttaaaactttgtagaaaatcccacacacccaatttggccttgtctgggaaatgtgaggattcctgtctcctgggacagacagtctcactgccaggcatcctccccctgcagtgattcacatcctacaatgtctgccctgatgtgtcaattgtagagtaggtccctcatggaggcccagaggccccagcccagagcccgtctgtcagtcattggctgagagtggttgggacaggtgaccccgcagttgaggcgaccccccacgatctctggaaaaggcagctgagccccagttgcagcaggttgggggagatggtgctgccacagcacaaaggacctagccccagtggcacccaccactgtcagaactctccactgagggccagggtggatctttcctcccacatccaagcgcatctgacatcttcaccttgaatcctgagtttctctcttaactctgtctcactttgtcatgaacaaactctttcttgaaagttgtatttctctggggccagaaaggcgaggaaagaggcgctttctcctgggaggtgggcctcgtgtgtccctgtcgtggctgagagtgactgccccagcacctatgaagaaagcccagagactctggaggctcagctgggataacgcctggcgtgctcgggggtcatggccaccgcctggactctggaaaaatgggaaaaatgctcttggcagacagcggggcagtcaggagggagctggccccaccagcccaggcaacgcccaagagctgtcctcccactcggctccaggagacgtttaaatggggcctgactcccccatctctgatttaaaagataaccagaagcagcagagaaaacatctgaagtgcttcctggacacacctgttaggaagtttctgcaagaacccaggtaagagctggactaagcgggggtccgtgggtgggaggagggagaacgcctgcctgggcatttacagagatgagtttgcagagataatgatgccagggtttcagccccagccccaggaagagaacggcagcaggaaaagttagagaggagagggagcaggaggtggagagctcggcccctccttcgctgctgccctctgggtgacgctcagcggaggcgccacgtagcagctgcgagagccccgagacaacctctgcactgtttatgggatcgcattaggggagcagcggccctgcatgaccccacaggtgagcaggacacctcatcatagggtaggcacgtgagcagactcaccctcacacagctgccttcagggctgcccaggtcaggtgctcagaacacaaaagaaagtgagacaaagtcgccaccctggagtttacgagctggcgtgggagacaggctggcactgaggatgacagtggagagagatcgggctgggaagaaccggaggcgctggggaagccgggtcagcagggagaccccagcagagtgggagccggaggacggcggcgactgcagcccgactgtttcaggtggcgtcctcgtcacgagaggagcttgagcgggtcgtggccttcctggcaacctgcctacagagaaaacgattgctgggtgcagatgtctcgaacatttattgcattccacgttgtcagtcaataaaacagctttgcgagcgtaatactgacaaaatcaagttcaggcggtaagccccagggcttccaagaaaagtggatcggggggcttgctcagctctggtatccagggggggccactgcctggttcccaggcaaaggagtacaaactgccgggagaaacaaggaccctgcaggaagaagggacctgcccgacttgttcccccgcacccacatcaggaattttcccagaaagccatccactttgttagagacaaaataaaggtcatttggagaaaaacctgccagcagctgctgctgcttgaaaatagaaaagattttaaaagtagcagtgttgggaggccaaggcaggcagatcacctgaggtcaggagttcgagaccagcctggccaacatggcgaaaccccgtctctactaaaaatagaaaaattagctgggcatggtggtgagcacctgtaatcccagctactcgggaggctgaggcaggagaatcacttaaacctgggaggcgaagattgcaatgagctgagattgtgccactgcactccagcctgggcaacagagcaggacatcgtctcaaaaaaaaaaaaaaaatgcagcagtggtttgaaatcatgcatttttatgtgttatcctcaaacatctgagggagataagaaagaatataccacggatgagaatatttataattatcagaaaaaaaactgcctcctaggaacaatcctgtgagctccatcatcaaatctgattcagaagcctccaaatcccctacttgccctggcagctgctacccacctcacagctgtcctttgcagattactacaaatgttctcttaaatattcatttatcccccagcattgacaggtgaggaatgatgttgcttgggctatttctgccccaggtggcccctgtaaagccgggaccttggatcccctctctcatatgagcctcctaagcgggctcccagctcctggatggggtcttctcagggcctagggccccctcatctgcccagaacaaacttcctcatccagatgtcaccattcacttccccaggtcctccttcccaccagacatgaggattttaacttgatcatctctgcaaagaccttatcttcaaatacagttacattctgaagtcctgggggttagggctgcaacacccgaattggtggagacaaaatccagctcctgacaataccgcgtatgatagctgcgtctctgcctgcagtactgttttccagggaaagcatctttgagtgtattcagaaagcctctctctggggccaggccttgcagagaatccttcagaaactggacaaccccacccaaggcagtcagtggggaggacacatttggtgcctcattggtccctggatctgcctcacagtcctcaatgttcctcctcgttccctctactctttctcctctttggttgaccttgaagctcattcctggtgaaggccccgtgggagcagtgcaatgacaagaggagcctgttttcaatagcaccctcacgctctccaggggtccattggaggcgcctatgacctcctgatgctgaggagcctagagtgggcagccctcgggcccaggctccacctgggtgaggcctgttttattatcaatactcaccacagtcatttgtgggagtgtaatgctcatattcccatttaagagatgaataaactgaggcaaggtgaagtgactcagctgaggccacaccacagtttaatggggaagccaggataagagctggcggcttctatgtctgatctacactctgatgggaggtcgtcagagagccatgtaaacggtgaggaggtgacatgctggtcccttccataaaagctgttttgcaaaattaaaacacacacacagtaaagatccagatttatgcaagtgagagtgaggggctgactatttaccagtcaacagatctccccaaatggttctctgcttggggttgagatgctcctgaccagcagggcttggggagagacattcttgctccccctagagctggctgacccatacccaggggattctgagcaccaggggctgggagcagcatgtaccacgtgtttcccaagagttagtcatgtttgctcctaaaacttattgtaatcgaggaatctaattaaacaatacaccaactgaagaaacagtgcaaaaagaatgagtgactgtttctatgaaaacttagatgaactactttggaaagattcaataaaaagcatgcctaaatacatatactggggccaggagcagtgattcacacttgtaaccccagtgctttgggaggctgaggtgggagggtggcttgaggctaggagtttgaaaccagcctaggcaacatagcaagaccctgtctctacaaaaaaacaaaaatttttcaactggttgtggcagcacctgcctatggtcccagctgctctggaagctgaggtgagaggatcactcgagcccaggagttcaggctgcagtgagccgcaagtgtgccactgcactccaccctgggcaacagagcaagaccctgtctctaaaaaaataaataaaatatgtacatccagatacagtattatgtgtgggcgagacaccggtaaaagatggaaacaatcataaaagtcaggcaggattccacctaagattgtctttagctctcaatctaccttgttttaaaatttttttatgagccataaaagacctaagactagtctttattgtacaacttgatgaattctgatcctgtggccatacagttcaaaatagagcattctagcactcagaaagctccctagtgccctcatcagttggtgcctgtcaaccccaaggatgtcatagtcatttggacacccctggcacagtcattccacttagagactctgccagaagtcccagatcataatcaggagtgaaatttacacaagaaggggccggaagccctagtgagtagtgaactcaactccaaaataaccctacactaaaaataaaactggaacgtactttttatgtttgaaatttaaataagatagatgtatttttgttaaatcgttccaacctgtacaacttttctattcatcagccaactagccagagaaagggggtttctgctgctgtcagagtataaaaatgagctgcaattttcaaaatttgacctcatctaactttctccagctatgccattcctggagcatcctcagtccagtgcctgatgcgtaaaacataataaaaaggtgaccccaccacaccaaacactggggtgtctgtagcagtgaccgcgtctcacggggattttgtctgaatgcctgttcctccactcgcctaatccatggaggtcagggaaccacgcacctcaacacacacagtagcttcttaataaatgttggtccatggaagtcaagtcagcccttaaagggaagggtaggaaacaggtgtgcagggagggaggagtaaagctgccctgggcctgccaggcctggggccaccccgcaggcaactctggagccagacagcctcggggcaccccaggctgagggaaggagctgggcacagccctgtgtccccgtctctcagccaatggaggaggagcttggtcagtccctacaaaggttgcagtggagaccctgcaccagggtacccacctacccatgaaggcacaggaggaacattctggaaatgaggaggcccttgtgaagccacagaggtgtggaacagcatggcacagcacccctgcaattcccataccctgtgaggaccccacagtcctcatctgtccctggatgtagtgcagtggttgtcctcggagtcgctggggtctctgcctgctggctctgccctagtcccgaactggacgccctggctcacagtccctccccacggcaccccctcctgcattccttggctcacccatgagcccctcttgggaatggctccccaactccactgcttcaggaaggagcagcttaatgcttcccgaagcttctccagccccaccccacttacccccatgatgtgagcgcttggacgcaccgtcccagtgacctgcctccacggtaaaagagggcctgaatgggggttcttcagtgcggggatcaggggctgatttcagaatctaacgactgtcattatgccgcatacacagaaaaatgaacacgagagctacaatttacataaaaatcccggatttggggagcccccatagaaccccaagaccaaagacaggtctctcaatgggaaaatttcaggaagcgacgccaggtgtcctaatcctctgaagcccagaatgtgtgtgcaccggggcggggctgccccggagaaggttcaggcgaccttcgcgtgaggactccaggcccctccggagaacattcctgagcctgcaccaactgccctccgttcgctcctctccaaagggtctcagaaaccctcaaaatagtgttaggaaaccatcttactaacgaatgtctgcctcttgctttccaccgtatttaaaactcttccttaagctgatatgaattttgttaaaagcacacggagaatgttttctcattgcctcccactctgagctaggtattccattcccccaaacactcctacatttagtaatgcgaaaaacagtgaaagatctcaaagcccatagatgaaagttaaatcagttctgacagaccccgatgtgtgatgaaatattatgcagccatttaaaatgatggaataatacttgaaatataaaaaagtttaaaatgcaaaccccagaagcatctacagtatatccccaattttctaacacacacgtgcacacacaggcttctaagaaatgattagaaggaaatacaccaatgtattaatattggttatctctggtaagactaaaagtaattttaattttcttttcttctttcctgtattttccatggtaagcatacattgatgttaattttttgattgaaaattctactggctccacggcctgtcttgtgtaatcacagctgagctcactcatcttctgggctttggcaccgtagggaggaaggcagcctttccccagtgtgcccttgggcaatccagatccaccccgagcctgggccctgctgggtactgcccaggcgatgccaggagagggctgagtggtggccgcagctgagtgcagacacatgtggtgcagagcacagcatgatgcagtgtgggacggtgggctttgcaaaccccaggaagggacagcggccaggtgctccgctccaagcccagtcccccaggcctcagtgagcacccccggctgtgacttgggccagccctccattcactcagccactgtctctctgaacatgccctgccctcctgccgggctggctgggctctaggagggggtgtcctgtgcaggaggcacatgtgagctcaagggcacaccaacccctctcactagtcatgagttgggcccagtgcaagcccgctcactcactgctcactcccgccaaggtcaagcttctgaaccccttcttagagacaaggagacctgggcttagccctcgagtccacgtggtcgccaacatgacatgacggagccagggcccccagccctgccccagcctggcccctcctccacactggcttctgtgcctcctgcagggccagcttctcagcagcgcctctctctgcaggaattcactcactcggaagctgggcagactcaacccagagctttggcctcctggacttgggcatgctcctgtgtaatgaggaagggcctcattttaaacaaccagatcttgtgagaaatctttcacgagacagtagcaaggggagggtgctaaaccattagaaactgccccgtgatccaatcacctcccactaggccccagctccagcactggggatgtcagttgagcctgagatttgggtggggacacagatccaaaccgtatcagaagggaagagagccatcccgggagtgggcaggctttcccggtggaccttggggagtcaccccacatctgtgtcagtacagccagacttaacaatggaaagagccaccagaccagttcaggaagctgggcgggagatgcctcaaggagatgaggccagcagtatggagcagcaagtccccctgtgcccccactctggggagctgcaagaatgacctcacaggccctgccttcccccacaccctgtaggctgcgcagctcccccagcaagacatggagctgtcttcccacccctggaattgctggtcatgtgctgtgcctcagccagcagaggtgacagggtgaccttggcctggttccccctgagctcactggctttttttttttgctttaagttctgggatacatgtgcagaacgtgcaggtttgttacatagctatacatgtgccatggtggtttgctgcacctgtcaacccgtcacctaggttttaagcccggcatactttaggtatttgtcctaatgctctccctctcctttcccccaaggtgagcaggtccctggcacagccacacccaaaccaaaggtgcccttggaaaggtcactgtcttcattgctcaggctggtttgagtcaggttcctgtcacttgtaacaaatccactggatttccaagcctccaaccacacctctgcctcaggtccagtgcactgagacccagcccacagctctcatcatgttgcagccccttcaccacttccagcatcatctcattttccaacaggctgaaatccaaatgtgttcactttcgtaatccagtactccccatgacctggtcctaatctgcatctccaccaccattgcccatcattcactagataagcacatgcctactattgcaggcactcagatcgtgaacacatattggatgaagcagcaaagagccctgcccccggggggaagacagacaccaaatggggaacacaataaataagtaaattgtatagtatgtgagaagattgtaagtgctttgacggaaaggaaggaagggagggagggagggagggagggagggagggagggaaaaaaataagagaaagaaagaaaatgtcccctttccaaaaacaagaacgctggcttccaacagcactggtggaatcttgtatttgctcaaccctacaagacagaaaatcattacagaattgctaccttgcaccacagtgaaagcaaacccacaagtcaagttcaatatttgtttgcaggtattttgtctgcaggacaagggttataggtcaaggttccgtgttcaatgttacttgggttagtttctgttgtggtggtggggttggtttgttggtttggtttcttgccttgttttgatttggtttggttttggcgtggtcatgttactatctgaaatacagttagctcatatttcccacatgctgtgataaatgttgttaataagtcagcctctgtggaccagctggattgtgtgttctccctgctaacccagagcacactgaaggcaggtgcttattatcctattcatctttatgtctttaacgccaatcacaatttctgtcatagagtaggtgcacaggaaatatttgttaaattcaaccactgaacctaaagggtttctggaaaacttttttgcaaaatccatgtaaatgccataataaataatttgcctatatattcatagactagcatccaaaccacaagcacttactttatgaataattcagacatatgaagagctgattaatgactcataatttagaaccccacctactgtcccctgggtgggggggccagggctgctctccaatgcctacctcatgccctgtgcagaacacgtgaggctcacccacctccaaacagatgcagtgcgccctctgcctcaggcagggcactccccaacacatgggcagctgctcacacagagatggtattagggccttttggggatttgggaatcttgaacactcatgggaagattgataggcttctgggatgccttccatggagcggctcgggacaaatttgtgaatgcagcggccaaaagatctgcaatccgtcatgggttgagtagagctacccaatgcgccagcagcatagggaaaatgctgaggaaaatgtgacggcaggtgcccactcttaaagcagccacaagtctttactgaggtcctgccgggtcagatcctatgctggatataatagggaaggcgtgcgtttgaaaggatttctcagccgcagacgcaagccacgcatagcgctcggtgagagactggtgtccaggagcatggaccgaggtgcagtggtggggctggacttgagaatgactttcaactgccaggatctggtgaccaaccggatgtcagggacagagagaaaggcccaggtggggaaaactcaaggcttccagtgtgggaggctgctccactcagctggaccccaagggtcctggggaaagggcctatttgacgggcagcagaatgagctgctcagaaaacaggaaagagaagacatcatttcagacctgaggcagcgccgacctatttggaaagaagaaatacacagatgaagcccctaaaatcatttaagtgaaaggaaaataaaatctcaagacccagttcattctgccaaagggaaaagctaagctgggactgaggcatgcaagcctctgcctttccttctgctccagagcaaattgctgcggaaagcaggccaggggtctccacagggagctgctcttatgctgactttatcttatgcaaagatttactgagcacaagacaaatacatgatggatgattcctgtacccgctcctttccaatgcgatgtgtggactcagacatatgaccacaccccctccccttcccctcctgcctgctttgcccctttcagtattaaagccctcaaaatcctctttggaaaaattggatctcaggttgttcctgtggtttcctgttccttttccccaggcacatcctgaatgttggcagaataaacctctgagttgattgaggcctgtctctgccactttttggtttacaactataaagggtgactgcataagggctgagataaatgacaagaaatgtattggaaagacatggtattcatcctggaagccttcctgcagttggggagactcaagccaggctttaaagaacatgaggggtgaccagaagaatatccccaaatgagaaggcaaatactcagaaacacaaacctctcgattagaaattctgttttaagataaagcactggtggaggggggacagagagacagaaccagagagggacagaaagaaagggagggagagaggaagggagagaaatagacacagaggaaagaagaaaggaggagaaaagagagggagagtaagagcggggagagagaagaggaaggagaaacgtttcattttgcttggggacagagcacttaggaaaacaattgaaatctgtccaggaagcgcctttctattttctttctgcttctaagtaaataatctaaagcctcatgtcaagttgtttgcatagctctagtagctaaggttagtttatttaattaaagtgatgatttcaggccaccaccaggagtgaattagaactgtctcctcgctgctctccaaaaccccatcaaggtgactctctccgcccgaccctggaggctatttttatcctcttgatcttggtgtgattagtaaaggcaattaagcagccggatcaaagctcagggcctcacgccttttagatgttccttaacaaccctggcagggtttgcaggaataagcccgtgtggaggcaagcatgggcatgaataaagatcacctgagaaggcggagggctgctggggagacggtagcaggaggccatccagggaggggctgggaggcagggatgccccatcctactgctctggggtgcctgtcccattctgtgccctgtgcatgtgcctcctcctaagaagatgaattctttggggtttataaagaacctctctcttctgtcttaattcagtgagagacacgccccttctgctgtcctgcagccataaattgaaggcccctgcaggcccctgaggcctaccctaaattttgctgtggtcttaaaaaataaaggtgttctacattttaaaaaaaagaattcctgagacacaaggaccagtcagtatttataggctacaaaacaaataaaccgggttaacttcattttcccattgaacctgtgtgaggggcatagaggggtcagggttcaatcaggcttcccacagcagggcagctcccaggaagagaggttgaacctgaaagagcgcacagacaggcggggaccgcgctcttgcccaggcctacagctggtgggcaccagaccctgggctcggacccctggttcgatgccgtgtgatgttgcactggctgccccgcagctgatgcagcggggaaggaacgggactgaggagcagtggcatttggaagtcagagtttccacaagcaccagttaagtgcatggatttctctcccagggatttccttcttcccagaccttggggccttcatctccagcctctcagaaggaataaattctcagaaatacaggatccacacacatagcctgccagaagcctgtgccactgcgtaagtgtgagtgactacggaagacaaggtggactccaaacccgacgctatgatccactcgagcctcgtccagggaatttatggagcacgtgggacctccctgccatccagaagcacagaggaggtgcgtccccacaacaatgccaggaacacacagcggggaattctctgacatcgagaggcttccagtgaggggcactggctgccctggaggtgacagagactccacatcagctacctgctgagatggtgctgggagcctcgtggagcagagcagccgatccgatccagggtacctgctacaggcctggcaccacctggtaggtcattgcgggaggacttgttcaggctctgatgaccctgtcagacagagagacagagagtccgagagaaacagagacacagagaaacagagaagcagagacagagacagaccaacggaggaagagaaaaatacagagagagacagagatagagagaagcagagacagaccgagagaaaaaaatacagagagacagggacagagacagaatcagagtgagacagagagaacaagggaaagacccggagagagaaatgcagagaaagaaagagacagagacagagagatacaaagagacagagacagaaatagagagacacgcgtgtctcccaggccgccgtcccgcccagttctaggcctggctgcagtcctgcccccggtgcccagagagcccttctcccatcacgggccatctccactgagccatgtgctaagcatcagctcctgggagccacggtgtcccctcacacctgcagtgaggactgagaaagctgcagatgggaggcgaggcagcgacacagccggctggcactaggcatggggtgacaaggtgcatggcgcggccaggacagccttgtgcaggggacagcggaagctcaggagacaaggtcagaggtggtggggccccgccacggagggcaccgaggggaggaactggggcttcattttgcggaatgagagtggaggccatgaaaccgaacctcatgcacccccagccacagcagcctcatcaacggccccgctgctgccgcgggaatcgcccacactacccacaggctccccaccagccctgggtgcaggagacactgaggtaggtcctgtcctgggaggtgtgggagcctgctgagggctggctttggcgggagctccagcccatgggggaacagtggccagcgctgggaagtaaagatcccccacgcctaggctggccagtttccatgggggcagcacagcccacctcacgtctccagtggctcacactcggaacgtttgccagcctgctctgctgagcggtgtgagccacctgagtggccccagcacctcccagctgatgcccccacctgcagcccccaggacgcacccccactcctgcaggctcagaccccactgcagcctgggctcccagccgccgccagtgctcacacgttttctcctgcaggtgtttttcccaataaaatctgtgcatctctcatcctgtcttggtgtctgcttctcgggagacacagagtctcacacgggaaacgtgttgtcagctgtgaggggtgggtgggggtggagataattgccatgagccatgccagggcctgagaaaggaaacagacacagagaaacagagaagcagaggcagagacagaccaatggagggagagaaaaatagagagagacagagagagagaagcagagacagaccgagagagaaaaaaatacagaaagacagggacagagacaggtggcgccctgcaggaggaggtggcagctgggtggagaatcagcaggggcggcggcatggcaagcccacctctctcccagggttcgcgaccgtgatctgctgacaggttggacaggcactggcaggtcactaccaagacgttagatgctgcaaagcacaaggcactcctcataagaacgcagtagtaattagaggtcctgtgtgggaacagtgccattcattaacagtgatcaccgtttgatatcgacagggtccgaccaacgtgcccgcaggatgcagaaagggcgcgtgatgagcacaggagagtttagagtggccccgcgcctgcttcccaagctccagagacactttctgcagcagccgcactcctgacaaatgggattttgggggaatcaagtgtgattttgattcactcggggagctcaccacttagaagaacgctgcggtttcaaccagtccttcagaaatgcagagagtgtgggaattccaatgaaaaggccctgaggagggcgtgcggttacggggtcccttgagcttgataaaggtaaggacaagggacaaaagcgcaggcagaggctgcgtgggggatcggagtgggggctgtggcctcggtacacagaggaggaagagctcagcagagtgagtccatgtccacagcctgctccgaagatcagggcagtgacccctggggaagaggattttgaaagatttggagggaagggctggttgcatgacaaagaagcggcaggaagaggttacaggtcctgtcggagccgcgttgcctctgcaaggctgggcgctggagaattctgcgctgggtggagtgagcatggtgacccagggctcaggccactgtcctggggctggaggcggccacagggggctgttgtcttgggccccccgctgctcactgctcctaaggagactgagtgtctctcgccccacacatctctgtctggacaaggaatttgcccaagggacctccctgagtccggagggaagaagggagaaaagttctgaccccagccctgccccccaccttccagccctgtcctaggtctgccagctgagctgtcccagcaccgtgccccgaggccctagagcacatgcgggcgaccagcactaagttagaggaccaacaactcagtggcacactgcctttcccccaccctggcctcctgatggggaagacaagaataagtaatcatgtttgctcacttccaccagggctggtgagaagctcaggaaagccaggggtggtgagcaatgtctggaggaggcgatgctgtggcagctgttcccgcatggcagctggccgtgtctccctcctcccatggggcccgtcagtgagcaccgtcccaagaaagaggacaaggcacctaggccagccaaggggggaggggagagcaatgaatcagggcctcctggagcccggaagggctgaggccacagcagtcctggagccctacatggcggggatgtcaggctaagggcagacatgatctaaaaaacgaaaagtggaagaagaaagaaaaccacgaggtgagcttccagaggctgggaatacgccactcctgataataacaataacaccaaccaccagcagcacatgtgcacacatggcacgtcccactctccaagctcctcacatgtgaagttccttcttccaaagccccagtctcattctgctcaagctgccatgggaaagtacgtcggacggggtggcttatgcagcagacgcctgggagtccaagatcaaggcgtcagcagggctggcgtggtgagggctctgcctgaggctgcgggggcacctcctgcctgtgtcctcacctggcctttcctctgcccacaggagagaagcaagcaatggtgtctctttcactccttataaagacacgactctacagggttgggcctcccctgtggcctcacttaagcttcatcccctccctacacaccctgtctccatgtgcagtcacaccgggttaggcctcagcataagagtattgggggcatgcagtccaacctctaacagcccattggagagaggcacaatcctattattcagccccttttacaggtgagggcctgaggcccaagaagttctttcttacctaagtaagtggcagagccagaactccaactaaggcagtttctctgttaaaaataaatagtttataatctccagaagagcggcctgtcatggcaagaggtaggtgtcagtttggctcagaagggagaggtcctgtgttgatcttcctgtcccacttctcgcattttccagccttcctgtctttgctagggcagctccctcctgctagaaggttcttctcgatcatctcttttcccattaaaatctcatcatctttcaagaccagctcaagtgctgcctcctccaagaagtcctcctgatcactcctggcagaagtcgcctcctctatctctcagagcgtattccatcacaacgttcccacctggagagtggaattctgtacatatggatggagaagcacttgttatgctgggagatgagacgcttcacgagctacctgcctgctagattgcatgttgtctcctgacctcaagagcttgttttatgtgcagaacactagacgtctgatgatgcgaacaccgctggaaccctcattctgttagacggcaggcccgaagagcacacgccaaagttggtggcctaatcctcttggcatctgttatagtaaatgcattttcatgggaacacagccaggcccatttgcccaggtatcacccacggctgcttctgcactacaacagcagagttgcacagccacaaaccctaaaatattcactgtctggccctttcctcatatttacccgcccctgccccaaaccctccaccacgcggacctgattccatgcttctggctccccaggagcgaagccgtagatggtgtctctttcactccttataaagatacaattatacagggtaggggcccctccctgtgacctcacttagctcccagctgacccaatcagctcgcctcctccactgagggaaccctgccattctcggaggagggagtgtcgtctgaccaatacgctgaggaatgccagctgtccacaggctgccatctgatccctcactcacagaggaatcctttgtggaggtcagagtcattgatcatcataaaaacagtcacattcttgtgatcttggcagtgcctcacgaaacacaacctacaccacatcactcttgaatgttgtctcatagaaacttgtggacggattttattctgtattaaaaatgataaaatggaaggtgtggcatgttacataactctgcatcagctgcagaccatcactttctttctttttttttgagacggagtctcgctgtgttgcccaggctggagtgcagtggcacagtcttagctcactgcaacctctgcctcctgggttcaagtgattctcctgcctcagcctcccgagtagctaggattacaggcatgtgccaccatgcccagctaattttcatatttttagtagagacagggttttgccatgttggccaggctggtctcgaactgctgacctcaggtgatccacccaccttggcctcccaaagtgctgggattacaggcgtgagccacctcgcccggcccagaccatcactttcatgtgtggttgccaaaaagcctcagtcgaaaagaacatgtagatttacctaaaggcccaggaaaggggcctgttgaggtgaatgatgatgggcctcccaagggatggtccaccgtgcagccgttacaaatcatgctggggaagggaattatgtatgaatcttaggtggaaaaggttagaaaagatcctatctaccaggaaaagaaagaaaacgtggacttaataaggtcattatgccgagcaggggctttgggaatgtgcttgatcccttcacggctctagaacagctattccgccccagactcccatcacaaaaaccgcattcggggtctgttgcccgcagcacccacagttatcccgccccagactcccatcacaaaaaccgcatttggcatctgttgcctgcagcaccccatggatcaccacacacggctgtttcttacattggctcaagtttcagggatgagtgtgggcatgagtgccacggggaacgaggtgtgctcgagcctcctgagcactacctgaaggagacagaccgaccagtcctcccaggtttccgtctcggcagcggccgtccatccggctggcccgtccatgcccatgcccatgcccatgcccatgtactggcgattccaaagcttcattttacgtgaaaatcacaggggaaaagtgcagcttccctggcccctgttaccagggactctgattctgagggaccagactgggagtaggttccttccttaacaagtcctccgggattcagacgctggtggcccagaggccacccaagagacactgccgggagccgggcgggttcccccacatggcaggccagaggtctcactctgcacacatctctcctttctgctgttagagtcattcttttgtggaaacagcggcctgggctggtccccatcactgagacagaatccataggctcagatgaggcctaaacaatgatacaccagtctcatccactccacagcaccgaattttctgagatttaacgagagccgactcactgggaatatctccggagcaaggaattaaacgcctgaccagagcctcaaagtggaggacagaggcctccacccctggctgcccactgcagctgcttcggccaagtcatgcgacatttctgtcttgaccagtggaaacccatgcagttgttccctgtggtcgagggaacaatggccccagagacatccacgtctggatccctggaatgcgagcctgtgtcaggttccatggcagaggatgatggttgctcatcggtggccttgagacgagagattctcctggatcatccagtgggtgaatgtcatcccaggtgcttctggtgaggaggaagggagaggagtcggaggaagggctgcgctgccagatacagtcagagagatgctgctgcagctgcaagacagaagggcccaagcccagtgaggtggccatcctccaacctggaaaaggcaagaaaacgggggctcccctggagtccccagaaggatgcagtgtgctgacacctggccgtagcccagtgagacccgtagtggacctttgaaccacagaactctcggataataaatttgtgttgtcttaagccattaagtttgtggtaatttaccataatagcagcaaaagaaaactcccacagcccttgcccacttgaggacctgctgcaaagctgggaagaggaaggaggcaggaggcttcgctccgtccgtcctttctgttttagggcctgcacattttgttgttccttcttgatttctatccttaatgatcacagtgatttggggtaatatgagcatcaaagtgcttttttgctgaagacctgtttgcttgttgccagttttatagtgacccaatagaataagaccagtaaatttattgatggcagaaattagccatgtccttaaacgctttcacagggcagacagagacgtcttagtcttcgtggtggagttgagaccgaggcagtatcttcaaaggtgtattaaggtgcctttgttgtcggctttcaacgcctcctttgaaggactcgctcacttccccggcaggtgagtaagcagctcacagggaccccgtgagcaaagcctgcaaggggcagagccaggctgcaaacccaggccctgcacacggctctcacgcttctgtcacaccacacccagagcatcagtgcctctaatcaaccaacatttcagttcctacggttcaaaatgggccttacaggacttcaaagcatcgataattcagacatttgcttggtaaatcctctatcatggaatatgatgaaggcaacttcagatcaacaaactggtgtctgaattatcacacattctgaaatcagagacgtccagtgaaaagagatttgtctagtaaaagtaattccagatgtgtaacccaaaggactcgtctaggaagttccagtgggaaggactttgctgctctccagcacgagttattttctcccaggactttttcagcctgccagccgtacacttcccagacatttcaccaaatgaagagagaaaggaaaacaaacaaacgaaaagctttctttaagtagctttgaactttgcactagacagatccaaattcattggcttctgcactaaagctgtctccaagacatccctgttaggttcgtaactaaatcgcccactaatatttatgctctgtcttaaacaaaggaaataggagctgttgtcaaggacacggtggggcaggcaaggcgagccggtttctggtgcagacacagcccagagacaagcttcaaaaggacagctctgcctgggccctcagagacgcgcagctgcgtcagcgtggactctgggtggtgccggattgtggataatttgagggaatgcacagcacattaaggaggctgggaatgccgagggtctggtgggccagggtctctgagcccgacgtcctctcagccaccgttcagcctgacccaggacaggcctccaccctcccatgcgctcgacttctcactcagcagagacacgcagcttcagccagtgcagcagcaccacgcagcttcagccagtgggcagcacgtgggcagcaggaccacgtgcccaccagatgcctagtgtggtacgtcttggtcataaattagatccttaaacaaaaatgtaagtatacaaaaccacggcctcaccccaaaacgcccagaaggcaaacacactctcagccgaatggccttctgaccgagagcccttttgcggctgttaccccatttgatgtttagaacaatcccaagaggcagctgtggcatgggcatcagtcagggctccactggagggcactgaaccacaaggaaccagggccagggcctcaaccatccagcaaggtggccttgggggaacacacgaggatgacagccgggagacttcagtccaagtctctgctctgtcccttcatccccagacctggcttttcttatctgtaaaatacatggagggcctgcggtggtgtagacacagcatgagaacactgcttctcaagttttattgcatgttttttaaaaggcaatatcccagaccctatgtccagcgttttgttttgttttgttttgctttttgacagagtctcactctgtcgcccaggctggagtgcagtggcctgatctcggctcactgcaagctccacctcccaggttcacaccattctcctgcctcagcctcccgagtagttgggactacaggcgcccgccaccaagcccggctattttttttggattttttagtggagacggggtttcaccgtgttagccaggatggtctcgatctcctgacctcgtgatccacccgcctcggcctccccaagtgctgggattacaggcgtgagccaccgcgcccagccatccaagggttttgatgactatttctgagatgaaacctagaaatccatattttagcaagcttctaggcacttctgacacaggtggttcagactactgtcaaaacctggaaactttggagagcaaaagtgaggtgattaatgattaaactggggcaacagcatagcctgaggctgacgtgggcaagtttcaatggaaggtcacgcgagggccggccatgctttcggaagacgttcctctgtgtcattggaggagcagcgttggctgatctggtcagggattgcactcatgcctgtcataaacatcagaagagggtttactgtcagctgtggattaaaactcaaaggccagagatcaggctactgttcttcttccccatgagtgcaaatgcttttcccctgcatcagttggctccaataggctgattcttttaagggtcaaagtcccacactctcctttttattattaccctgtttcctaaacgaataagaagcaacagcacatttgagtcaccttttatcatcctaagatgccgctctttagtttctctttggggcacagccaaccgtgtccaatatccattctgcctgtcctcctcagtaaggaaaaaccgagtttgagctctctctgtggccatctggaatcaagattctgtttcccagctcctcatgcagtgaattgtggccacgtcgaagttcaggacatgggatggaagtagacttggcctgggcaccttcttggaagtgctccaaaagagaagggcataatctttcttgccctccttcctccctgttggctagaataggaatgtaagagctggcaccctggcagctctcctgggctatgagcaaccttgggaatggaatccaagcacagtggaacagagggctaaggaggaacccagttccctgccccaggggcacgtttcagccaaggatgtaatgtttccaggcctcctagctgtgacagagaagtcttatatcctttacacaatgctgttagttggaattatcctttgcttgctgtcataactaattctgacagacacaccttgcctgttccctcttctgtcagccaaggctggggaacagaacagaaaatcacgatgccgctgcgggagcaagagataccagggtggtcacgggaagagatccaccggggcaggttcccagaattccttttctccaccataattccacgcatcagccattgtatgaggcatctgtcatataagctcagtcactggagatgaaggcacttcacaaattcaacgccttttgcaaatgtacccactgtctctctcaacagctgtgctaggtggcccggcagggacagtaaatgcactgggcgctgagatgaagctccctgttcaccattggcgggcacgtgctcggtgtttcactgtgcgtggagaatgccaggctgccatgtaagcatctgaaggaggcaaagcgactctaccctatcacctccgggtccagcatcactgaggatccccccaagtgtggctcctgtggtgacacccagactcaccacctcaaacgaccccacctctgaaaccatcagctctaacttcacctccgtgcttctaggcccaccgaggcccctagcaccccctcagcccactctagcttcacttcctctccagcctttcccagagtccccggcccagcaccgagggctctcctgcaccctgccctgtgcacatctccatgccacacaggtctgttccggcacctgcccgcctgccaccgccttaccctggtgttcccagaactcctagagaaagcttcagtcacaagggtgccactgccatccctgctccagcccagggctcacggcgcccagcagtgctgctgccatcctcagagagctgttctgccctcctgccccaggctgccaggcctctgcccacttcagctggagcaacagggcttcccctggtgcacagagctaacgagaaagccagagtgaatcccacattcagccttcctacgcctctctctgtccctatgtctacctctgtctctctgtctctatctctctctgtccctctctgtctctgtccctctctctttctctcttgcttgctctgtctctctgtctctgtgtctgtttctgtctctgcctgtctctctgtctctctgtctctgtctctcacacacccctccactccaccctatctgtgcccctcgcccctcagtggcccgggcccccctcttcttctgcttgtagccaccccctcctaccagctgggtcctgccccatttcctccaggcccttggtccattgattctcttttaactctagcctatccctttcaatttattatttttaataagcagagaaagattcccaagactttaatcttaaaaagaaaagaaaagaaaaaattctaacctagaaacacatccccctaaatgtggccctgtgactccctcccagctcaggcagccaatcctccagaaactcccctcaagggctggcttcctcccgtctctgatttcctgtccctgcaaatcttccccccaagggagccagggtgctgctgggcacctctctaatgtgccttctcggtggcatgagacacagccaggcaccctccctgagggcggtctcctctatgactgagtctctctggcttcttgtcctgttttgccacctgctctcctcctggctctgtcttcactgattccctgaaagcagagcctgagcccgagcttctctctgctgcccactggggagtcccaaggaggggtggggaaggccaggaggctgattaggcaagtatgcagagtcggggtccccaaccggccactgagggctccaaacacagctggctgtgccctctcacagggctgagagcccccatgagctactgaggcccaaggtggcccatcaaaaggacaaagggaggagagctcctcaccatccttagtccaaggcccactcctgggactcttcagtagcaccactgaagagtgctgggtgcatcccaaatccgcagcagcagtgagcacggggcagaagcagccagcacctggggcctgaggcacatactgtgtgctgtgccccagggctcccaagaccagatcacctcggtggtgtctggggtgacttgcggggccaagagtccaggagacaagtgaaggctgaaagggcccagggcagggccaaggggtgtctccccatgaatagtaacaggcccaggccctgcccccgttcttcctgcccatgctagtctctcagctccacattcatatgtgccatccacagagacctcagcttcacatgtcagaaactaggctcaggacggtggttcccacaaaacttagaaacagaagtgtcaaaactagctcggtcggggagaccctaacccagcggtgctggaggaattaaagacatactcacagaaatatagacgtgggaagtgggaaatcaggggtttcacagccttcagagctgagaggcccgaacagagatttacccacgtgtttattaacagcaaaccagtcatcagcattgtttctatagatgttaaattaactaaaagtatcccttacgggaaacgaagggatggaccgaattaaaggaataggttgggctagttaactgcagcaggagcatgtccttaagtcacagatcactcatgctattgtttggcttaagaatgcctttaagcggttttccaccctgggtgggccaggtgttcctcgccctcatccctgtaaacccacaaccttccagcctgggcattaggggccattatgaacatgttacagtgctgcagagattttgtttatggccagtccagttttggggccagtttatggccagtccagttttggggccagtttatggccagattttggggggcctgctcccaatatgtcccccttctctgatttgcaaatcgataaaagcaaaggcagctttgtcacggtgagctacttcttgcaggagtcaggatccacatctgcagactatacaaagacaaacaacacagattaaaagcacaatcatctttgaaatcacagagcttccaagtgttttttctccattttcagctcctttgagcactccaggttctggaattaaggtcaggtgtgcctgggatgctttaaatatttgttcttttcattttaaatccttatgttaagctcctagagcagcccatatcatttgaggttgaggtgccactataccgccatggttccagataataggaactcttgccgtacttcttaccatttctaccatctgaccgttttgttcagatcatctgaacatagtgtggccgtggcacgcagactgagaggtgcagttcaagctaaacatccccttgggggaccaattaataatgattccgcaggaatcgttgtgcagcacctctgcctgttctgcaatgcaatcttccaaacaagtacgctcattttttctaactggttccaatcctgtttacaaataggtttttgagggtggtgtgtgtcaattataagagcagatttattatggtgaatactgagatcagaaagcatgtgtaactgtcagagtgattgcatccagtcattattgccagccaagatggataaataagtagaactgttctctgtgtaagcccttattgaaggaatactcacggcggtggtgataaccgctatcagagctatcattaaattattcattgtgactggttgtcccgctttcctcaggttttcttccgccatctgtgacagcttcctgttctgtccccaggtgggtggctgtgttcgatgggtgttgctcgtgacagttggggtcctccgcagcgtcagtcttgacatggctgcaaccgggggtcctcgggatcctcctggaatctcttcctctgcatctggctcatgataaggtttcaggtgtcttgatggtatccaaatcggctgttgattttggcctggagaaacacaagcataacctctaccccaagttattattttacctatttcccaacgttttgtaattggatctctccaccaaaccagttgttccgcttttgtctttgcagctggtttctgtaaatgctgttcagctgctgataacatctggtctttgggcaggctcaaaaaatttaaagttaataatgctaggttcagttgcatctatggggttccatatactctgtctccccctttctgcttttgcaactgctgttttagggaaagatacattctttccactatggcttgtccttgagaattgtatgggataccagtaatgtgtttaatattccacaaagagaaaaatgtagctagagtttggctaggatagcctggggcattatctgttttaatagaagctggaatgcccatcactgcaaaacactgcaagaggtgacatttaacacaggcagaaggctctcctgattggcctgtagcccaaagtgagaaaaggtgtccacacatacatgtacataagctagtctcccaaacgagggaagatgtgtgacatccatttgccaaacagagttaggttccaatcctcgaggattaactcctcctgtaaaagatgaagaatgggccatttggcaagttgggcatcgctggataatagctttagcttctttccaggtaatactgcatctgcgtttgagaccagaggcattcacatgggttaaattgtgaaagtgtctagcatttgagattgcattagcaattaggcggtcagccatttgattcccttcagccaaaggtcctggaaaaggtgtacgagacctaatgtgagtgatgtaaaaagggtgcattctacttctaactgctcttggcagttgggtaaataaagtcatcagttgttcatctgtatgaaatcgtaactgagcactttcaattaactgtgtggaatgaaccacgtatgaagaatcagaaatcacattaataggcatatcaaaagcagtcaatacctcaattacagctacaagctctgctttttgagctgaagtatagggcatctggaaaactttacttttcgagccagaataggaagctttaccattactagacccatctgtgaaacaatgaaaatgcttagcaggctgcaggttgtttactgcaggaattgtaaatgcaaacccttcacagtcttgctcagctaaagagatagtaaagaaactgtcttttaaatctatgactattaaaggccaattttttggaattatagtaggagaaggcaatcctggctgtaatgctcccataggttgtgtaactgaattaatggctcttaagtcagttaacattctccatttacctgattttttcttagttaggaaaactggagaattccaaggggaaaatgttggagctatgtgcccattttctaattgttcggtaactaatttctctaaagcctccagtttctctttgcttagcggccactgttctatccaaattggcttatctgttaaccattttaaaggtataggttctggaggcttaacaatggccaccatcaaaaatgatatcctaatctttggcgggaactttgtttttccacttgaagcggttccttcaaaccttgcaaattttttcctgttcccatgccagggacataccccatttcatgcatcatatgttgactttgagggctatataattgttctggaattagaacttgtgttccccattgttgtaataaatcccttccccataaatttataggtacagaagttataattggttgaatagtcccagattgtccatcgggcccttcacaatgcaaaacataactactttgatatacttcaggggctttaccaactccaactatgttaaattgagtgggtggaattggccacgcagacggccagtgctgtagagaaaggattgaaatgtccgctcctgtatctaccaaacctttaaatttctttccctgaatagttatttcacaggtaggacgtttatcagtaatttgatttacccaataagccgcgttgccttgtttatttgtgcttccaaatccacctgtttgtttaatttcacttttccccattttcacatacggcaaaattaggagctgtgctatgcgctctcctggctttgctttccagggaacagaagtagatataacaatttgaatttccccattgtaatctgaatcaatgactcctgtatgtatttgtaccccttttaaacttaaactaggccttcctaaaactaatcctattgtccccgctggcaagggtccacagactcctgttgggaccttttgcaggggttccccaggcagaagactcacagcttttgtgcagcataaatctactgcggcactaccggctgtggcgggggacagacattgtacagggttgagagaatggcctgagctggaaatgccccggtttagaatggagcctgggacgggcccctcatagcatttcctgaaatcgagttcccttctttatcaaacttagagtgacactcattagcccaatgttttccttttttacattttggacctatttcaggatcagcagttttctttttcccctatctggcagactgacttgctgattttttctacattcttttttagtatgaccatgcttcccacagttaaaacaagctccaggaaatggagtattttccttatccactctcagtcctgccattgcctgtgccatcaaagtagctttatgcagattacctccaataccatcacaggccttgatataatcaactaaatgtgctttctctctgataggtcacagagcagcctggcaatcgggattagcattgtcgaaagctaataactgcagcactatatcctgagcagccgaatctgcaatcatcttttcaagagactcctgtaaccgagctataaaatcaacatatggttttcttggtccctgttttatagcactaaaggaagggtattgtttcccacctgaagtgattttttccccagctctaatgcacactcctctaaggtgttctatggcatcatcctgcatgaccagttatgcatcgaaaccagcccagccgccaacccctaaaagctggtctgcagctatattaattcgaggttgggcctgggcattgtgagcagcctgaatggaagcttcatctgcccacgaagttttaaattgtaagaaatgagcaggagttagacaagctcaagtaagagcgtcctcatcagtaggaatcatcctattggaaacagcaacattctttaactgtcccattaccaaaggagaacctggtccatactgatttatagcttgtttaaattctttgagtaatttaaaaggaaaaggctcaaatgtagctatatttcccattgatctggggggtgtattctaacagggaactgccaagcctcgaaatcaccctctcatttagcttgctgaattcctgcctgaatagaactaagagtggtcactcaaggcactgctcaaacagtcactggggcaactacttttcgcccagtgtcctccagaaaagaaagatctggagggtctttttcttcaaagtagtaaggagggagtgcagaagggtagggatgaacctctccttcctttgctgctttagctttagctggtaaataaacatgctctgtaaccccttctgttacttcactatactctccttcctcatcatcagtgtgaaaaagttccaaggtgaaacgaaccagaccccacatctgtcccattgttaccctgatgcttctgagctccccttcttactcaccacagggattgctttaagagtactcgagtgtcctccagctagttttccactccaaccattgttctggcaacccttcgacctggatttgagtccccacgatggacgccacttgctgagaccagctaggtcagggagaccctaacccagcagtactagaggaattaaagacacacacacagaaatatagaggtgtgagttgggaaatcaggggtctcacagccttcagagctgagagccctgaacagagatttacccatgtatttattaacagcaaaccagtcattagcattgtttctatagatgttaaattaactaatagtatcccttatgggaaacgaagggatgggtcaaattaaaggaacaggctgggctagttaactgcagcaggagcacgtccttaaggcagaaatcgctcatgctattgtttgtggcttaagaatgcctttaagtggttttccaccctgggcgggccaagtgttccttgccctcatccccgtaaatagacaagcttctagcttgggctttagggccattatgaacatgtcacagtgctgcagagattttgtttatggccagttttggggccagtttatggccagattttggggggcctgctcccaacacagaagtgccatgtgacccctcagttccacttctgggtctatcccccaaaggactgaaagcagggactcgaggagtatgcccagccatgtcacagcagcaccatccacagcagccaagggtggaggcaacccacatgtccatcagccaatgaggaataaacacagtgtgccccacccacgtggaacaacggattattcagccttaaaaaggaaggaaattcggacacacagcacaacacggaagaggcttggagttgttacaccgagtggagggaaccagccacgggactagcactgtgtaatcccactacgggcccctggaacagtcaacccatggagacaggaagtagaggggtgggtgtcagggtgggtgtcagggctggcagagaggaatggggagctagtgttgaagcaggacagggcttactttggcgacgagaaagccctagagagccagtgcagaacaatgcaagtatactcaactgtagagctgaaaatgattcagatgggaaattttctcatgtgtattttaccaaaaatcttaaaaaacaaagctgcactcatctctccctccagacttgccccttctccgcatgtctcactcttggatggcacctccatgctcctagtggccaggccaggggtgggccatcctgactcactgccacccagctggtcccaagtcctgcatctccaccccagcggctgcagtcctcccccatccccagcgcagcacccttccctcctcacccagatcacccaaaagcttcccagcagtttccagcttcttgtctgttgccatccgtgtagttaccccagccatctataactttctaacggttacatcttaccatataattattttctgtttaaagccctcctgcagccctcgatggcctcaggatcaagttcaaaccctcagcagggcccaaggcctctccatccctccctctgcaggcccagctcctggatgctccctcctctcacccatcccaggggccggcactattctgccatctgcgtagagtgccacccctgcctgcatcagctcatcctcaaaagcatctctgttcttagggagagaacatccccagcccattgcctctgcaggtctgggtaagctcatgatgtcctctgcccgcctccatcatgggggctaatttgccttctataatgaggcctgagagggagggccccatccgtccatttaagctttggacacttggaggctgaagcagtgagggggtgagccccattttctcacccactctgaaagtgcaggatgagccctcaaatccaaaggcccgggcatagccaggtgtctccttggaagtaaagatctttttcatgtgacttaaaagaaaattacaaggcttcagagacctaatgtgctcctaaaatgtgaaagccactcttgataataagccttaagaaagctcgctcatttatgaagccaaaggaaaagaatggaatttaaaagatctgtgggtagagctcttttgaaaaccttgatgtattagtccattctcacactgctaggaagaaattcccaagatagggtagtttataaaggaaagaggcttaactgactcacagttctgcagggctgggaaggcctcaggaaacttacgatcatgacggaaggggaagcaaacatatccttcttcacgtggtggcagcaagaaatgcagagcgaatgaggggaaagcgccttataaaaccatcagatctcgtgagaactcactcagtatcatgagaacagcatgagggtatctgcccccatgattcaattaccttccactgggtccttcccaccatgcgtggggattatgggaactagagttcaagatgagatttgggtggggacaccactaaaccatctcattcaatgagaagggaaaaaagtgaatgatgttatttaggtatctgttcatgtatttaacgagcatgtgttgagcaccaagtgtatgccaggaacagaggctcctgcaggcagtttcctgatttcaggcactaatgacgtgacttgtttcagcacaaatttatcaaaggcttctgtgttctgatcacctgggtgtagaacaacactcaaggcaaagtcattgctttcgtagttttgagtttttatccgctaaggaagtatgacaatataaaataagatttagtaaataatttcattcaattgcagatggtaatcagtggtgtggaagaaaaaaataaggtgaggtgagtgcgtgagcgggtgggagaccctcactgagtaaatggctttggagctagctagaatcaaataatgtgaataaagccatttttaatggcagggaacgagggttctaggcagagggaaacccacatgcacaggcgatgccaaccttgtcacgtctggggagcaggtggggctgcgtggtgtgggcccatcgcccacgccgaggctttgggatttgttctggggaagctgggaggccaagagagagcttggggcttagggcagagcagtgttaggccctgatttgtgttccaagctcactggctgctctgtgcaatagaggacgggaacggctgcagcagggagcccaccagaggctgtctgcacactccaggtgagagtgatgcccaggggcttagcacggcgaggagaggccccatccaggtgtgttttgaagaaagagacagtcctgctgcttggtttggatatgcagcatgggggggcattgaagagtaaataaatgatgcttttcaggtgctgcctgagcaactgggcaaaaggcagtgccatttacttggacatgagaacctagggaaagtcgggcttctgttttgtacagttgaagaggcctttggatatcaagtggagacgcaccgttagttacagagtcaagtccggagttccaggcttgtagactgcagacgctgcgaaagatggcattgaagccttggaaaagacaagagtgtgtggagggagtgtgatcgctggacacccttccgcagggcgtaggaacacaggcccctggcagttgcagatgcacagaaatgatggtattggaactgggtcaagaagaacacgagatctttagcaagtggagttgcgacaaggtgctgcgggcagatggaaggctaagcggaggcgggacgaataagatgtatattccacgtgtaaaatatctggaagcttagcatgactggaatgttccggagagacctaagggatgtatgcccccctagggagtgtcaccttgattccacagccagtggagtaccagggacatcttcagttttgtttcttaattgacacagagcatggtggacctgttagcatcttgttcaaagattgccagttacatgttgactcttgctcaaagaggaacgcacacaggcacatgtactgcacaccccagaatcttcagcatagtgtgaatcctgtgaagtgaagctctctgtctttgggttaaatatctgcctttaggagatttaaatgctgagtcacagtcgtgaaattcttgactcgattatatggaattgacttatatgaggcatctggaaatttcttttgagaggtcagtagcagaaaaataaaaaagcattctctgtttcccatgattcataaacccattagcaattctctgtaaactgctcagaaaccagagatgagcagtgagttcctgagccacccagcgaggggctgaggggctcaggacaccttcccaggcccagctccaatctggggtgaggctcccggacaggggcccttcctctccatctcctcagtggtcccctgtcctcagggccacgttgggactgccccatgctggggctgtcccgcaggctggcccgggtgctattcacctgctcaccctcacagctcagcagcatgtgctgccttatgacatcaatgtctctgtcccatggggcctcacagagctccccaagaactccgtgtttcccgatgaagggatcaaagacccagaaaagtgactggcagtccagggccccagatgtcctcagctcagggctggacacccggtgctgcctgggctctgtgtccatccataagcacgtcccagaccctcttacctgccaggggccctctttgtgggggaccctacaggcaggacagtcgggaaggttcctgccttcaggcagcttctcgcatagtgggaagacagaccagaaaagaaaagaaacacacagtgaggcctcagaactgtgggcatagggagaatgtgcgtccctgagggcatctcacctggctctggagaccctgtgcatggggcagcttctctgaggggacatgattgaaactaggccaggacgacaaatctgaccagagcccagggttggaagaggtggtgagcaacgaggctggagacactgagcccagctgctctgggtctctcgcagacctgatatagcagggacacagtgtccatgcccaaggtgccggtgctccgtgaggatggctggcccactatggacatctcccgagcctgccgtgtgcttcacagggtgaggatagggcttcaggggtcgcacacatcagctcagcctccataacaacgtcccacagactggggactcacacaagaagttcattctctcatgttctggaggctggaagttcaagaccaagtctagcagggttgctgccctctgaggcctcctgtattcatcagtcggttttcatgctgctaataaagacattcttgagactgggtaatttataaaagaaagaggtttaatggactcaccgttccacatgtctgggaaggcctcacaatcatggcagaaggtgaacgaggggcaaagacacgtcttccatggtggtaggcaagagagcttgtgccgggggaactcccctttataaaaccatcagatctcgagagactgattcactaccatgagaacagcatgggtgaagcagccccatgattcagtcatctccacctggccccaaccttgacgcatggagattattacaattcaaggtgagatttgggtggtgacacagtcaaaccccatcccctccttcttcagctggtagatggcatcctctccctgcatcctcacaggtcttcccactgcgtgtgtctgtgtctaacctgccctttgcatattgcactaaggtccacgcatatgaccccaacttaactcagtcgcctcttggaagaccccatctccaaatacattctgaggtcctggggattaggatttccacagacagatttgaggagatgcgattcagcccataccaggtgttacatggttttaacccacccacaaaccctgcaagaccttcaagcttgactctccaggggtcgaaggggatgcatcttgccctaattcactcagccagaagtggccgggtcacctctcattccccagtgacacgttttccttccacgtccacagcagctgaaatgtcctggcagtaacctgaaagacagtgagtaaagggccctgggagccccgtggttcagtgtcgcccgggtgctgaggagaatgtgaggaaacccaggagaggttccctccactcaggacgggtgcagtagtgttgggctgttgttctaacacccaggggataattgggcgctgttccagtctctatcctaaagaacatggaaggaactcaacctcaagattcaagattccttaaagattcccccagccacctctgggacagcaaggacagggaggggaagggaggccctgctgttcctggaggcagctgtgtccctgccttccctggagttgcatcaattttccaataaatttcccctgctaccaacatgaattaggttgtatttcttctatttgcacccaagagagaacagtcgctgatgtaggcttttctcaggtaacgaaggtaagatgactgtgacatggtttctttccattgcacagccacggcctgtgtctttcagggtctcaaaaccctccagggagggggtagcggctggggccacccttacccagccttccagctccttagaagtacagcagagaggtggccaggtgcggtggctcacacctgtaatcccagcactttgggaggccacggtgggcagatcacctgaggtcacgagttcaagaccagcctggccaacatggtgaaaccctgtttttactaaaaatacaaaaattattcgggcatgttggtgggtgcctgtaatcccagctacttgggaggctgaggcaggaggatcacttaagcccaggaggtggaggttgcagtgagccgagatcctgccactgcactccaggctgggtgacacagcgagactccatctcaaacaaacaaacaaacaaacaataaagaagtgcagcatggaggtgtcctgagtcagagaccccgcagacccatcagtacagttttctccagcaggaggaagggctgccataagagtcgcaaccccacaatggaaggagccccttacaggtgggcggaatgggagctgtcagagcccaagggctcctgtcaccagctgctctccccttgttcgacctttgccctgtttggggctgaatggtgtctcctcctctccacattcctatgatgaagccctggcctccagcacctcagaaggtgactttacttggaaatagggccatgcaggtgtaattagctaagaagggtcatcctggaggaatgcatcccctaatctgactgctccttatgaaaagaataccctgtggagagaaaagggtgcatatggagggaagaccaagaacaagacacaggaaaaaggccatcgctaagccaaggggccaaagatggtcagcagcccaccagggagagaggcctggggccaattccccctcactgcctccaaaggagtcaacactgaggatcttgacctggtctcggacttccagcctccagaactgtggggctgtccatcctgttgtttaacctgctggtctgtggtgctttgtggctcccatgacaagctcccagcatcctctccctctcctggactggggttaggtctcttgtttgcaatccatctctctccaccacctgccctggggcactggaaggcagatggcacaggataaataggcatgggagggaaggggtgggatgctagtgggaaagaaagaattaggatgaatctatacaagagggaagtcaaaaggtggggacccaggctcagagcatctcagcaacagaagtcacaaaaatatcaaaaggagggtgaagaagctgggcttggtggctcacacctgtaatcccagcatttttggaggccgaggcaggtagatcacttgaggtcaggcgttcaagaccagcctgaccaacatggtgaaacctactaaaaatacaaaaattagctgggcatggtggcacaggcctgtagtcccagctactcaggaggctgaggcagagaatcgctagaacctgggaggtggaggctgaggtgagccgagatcatgacactgcactccagcccacgtgacagagtgagactccatctcaaaaaaaacaaaaacaaaacaaacaaaagaaaggtgaagagactccagaaggcaggtggcttagcaaactctcagctgccggtcttgtgcctctccgttccatggcctcagggtggggcagaggtaaattgcaatccctggacaggcttggatccacagtcgacccaacgtgaacacaggctgcgattccatggtctctggtgaccacatgtcctcctggtcccctccctgatggagcaccttgtatcctacctccactgcccactcgctctctcaggtccagccaagtcctctgacagaggtagtgtgacctagggagtctccggaatggcacaatctctcccagggggtgttcccatggtgcacagggcaaggttatccaagttccaagaaaacattctgtttgtggacctgacttaccggagcacatgagtgaaagcagataggaataagcagatcacggctcagctccgggtgcggggtggaaatcagggttaaccagagggcaatgggagaaaatgatgtggggcactcatttaaattatctgcaggactctgtatcatgaagataaacttattgcagccctagctcatgtttccagagcagagtcctgaggagaaggagcacttaccaaggacgaatgggtcactgcgtggtctgcaaatagcatctggaaaacaagaagctgggaccttggaaacagcaagagtcagagttggtcggggagcttgccctggacacagtgggcttcagtctagaagacaccgaaagacagagcgaactccctcctcctacaaactgttcacacagtgggaaggaggacggggtttagcaacacgctgtctcaaaaatgtgcactgtcaggcaaatatgtgcttgtaacaccagccctggagaggaaagtctctctgggcttcggtccctaacctttaccctaaacattaatatatcaatcggcagcggccctggagaagttgctgatggcatcagagaatgagggcattcactaagctgtcacagcagacccagatgcagtggcggaattaatttttccttcattaatcatatcctaatttgcatgattaatatgtcatagttgatgaacacgggcggatacaaataaaatcactgaacaaaaatgccacctgctgagcaaaaagaataagacaaacaagtgagttggcacagctaaatgagcaggagtcactttatttcccaaaaacaatattccaaaagcttgaaacaatgccactattggggccgcttgccgaggactgtggagacagacattcccagagttttccacggtgggatgagctccagggtacacacaactgtcacagcttgccattggacaattctaaaaactcacctttcgaacctcgcctgtttcccaagcggaacccaggccaaggggcgggatgttccaggacaaagtggtgccacctcgtcagcccaggcccacttcctccagctacgaacctcagccatttctggccagcggctctggggcagaaactggggcagggcattgccaaggacacaagcaaggggagcggaggaggagaggaagcagggagcgaccgtggaatggcctcggacctggggcagagccttcgggatgctggaagctgctcaggggccgtggctgaggcccaggcagccaccaggggggactccgactggggtccaggggcaggcaatgcccagcctccctggagcgtgggtttccttcaaggccacgtggcagaagcagccacaggagaagcagcgcagttttccgcagcggtgggaatgtcctagacctggcacatcccgacagtagtcactggcacacgtggcagtggaacacatgaatgtggccagggcggctgagaagcagacattttcatttcattttaattaatttaaattgaaaaacccacgtagggctagtggtccctggcgggcagctgaagggagtgtggggaccacagcacttccctggctgtgggacctggagaggtattcctcctttgcagctccgtcctcctctgaggctgaggggttggatgggggcatccctggagcccccagtctgcacttcctgactggagtgtggaaggcgcctgctctgtttgtttccactatccttccacaaccttcactgtctccctcccctctgcttaccgaaaactgcctcctgccagactaagttcctggcccctcactttccagccgcatcccccacgtctctaccacgtgaacagaccctcagccctcaaacacacctgtgcctcccacaccaccccgtaccttgtctgtgccattccccatggctcttccccacccactcaatactgatggagacccacctcaagcctgatgttctggaagcttcccagagctccatggcccacaggcttctcactcccccaccatttagaaggaacccagcctctggctgtggtagcttgcagggcagtcctctttatctcactgttacttgatagcaacaatgttgcaatgtcttggaaactgtgtaacaacctggcaaggctgagcacacctgcccacagagcggggaggtgcgcagcctgtcctcaacgccaactagcagggcggcctgaggaggtgactgcatctcctcatggtctcctcaccggaaacatgaggatcatgctgcttccttttggggttcatgtaagagccaggcgctcacctgtgccaaacgccctgcccgccctggcctgggttcagggttttcaatccatgctgtgctccctaaaagacaggccactcctctgctctccagcacctgaggaaacgttgttgctggttgcaggattccttagtctaatcctaacacctcagtggcttcatcctggcctcatgcattgtgctggagcctggtttctggtgcaggaaagttgtaagaatgcgttccctgccatctcgtttctattttgaactatctggcccaaacccttttctttagttttctcctcttcccttggggaaaaagaaaaggagaaaaaaggaaagaaaaggacaaaaaagaaatggagaagagaagcaagacagaggctgctctgaaatggtttctgcaccttctccaatacaaagggcagtaagattgagtaggatgagacagctatgacttcctattcccttttcccagcccccaggctaaaaaatatggtgggtctgaggttctactccccaaccccggccaacgctcaagcctagacaagagttggatgctccacgggagtaacgtgagacccaggaaggccacgtctcattttaacttcctctcctctattccataccacaatctccggggagcttcaatggatggagaaagttctatgcctgcaagaactgaatttaccatcagtgccttcatatttgtgataaccttgttttcccgttccttcagggatgctgcgctgagtgaagatcttcatgaataccgtgtgtgaggcaagtaaaagcggctccttgtggctcattcgctgcataaggtcccattcagagactcaaatccagaaactaaacatcattgaaaaggaatcctaacctctggtgctcctaaccaggagccgcatttctctaggacctctgccttggcctttccagcgccctgtgcccacagcggccctgcttgagccagtcataagcaaggcccccagctcctccccagccccgtccctctgggctcttctatttccccgcccagaggaaaacattcccagctatacagaagcagatgggatgggggttaccagggaggctccagagaaatggggagatgcaggtcaaggggagagagtcgcagtgaggtaggaggaatcagtccagaggctggctcgcaggaagatcgcagttcacagcactgcagcacaccccgggacttcaccaggagagtagattttagactctcttaccaccaaaatgatgaagaaaaagaagaagaagaggaagaggaagaggaagaagaagaagaagaagaagaaggggaaaggggaaggggaagggggagagggagggggaggggaagaagaaggggaagaggaggaagaagaggaagaagaggaggaggaggaggaggaggaccgggcggtgatggatttgagaacttgcctgactgtcttaatcaccatgtctatggatatcaacacagcaggtcataaatgttaaaaatcacgtccacccttaaacatatgcatttcttaaaaaggaaatgcgtcaccagccacatgtgtgagtcgaaattatctcatagacacatttgtaaaaagtaaaagaaggatgaaacttaatattatgctttaaccgagtacatccaaaatatcaatgaattacttataagatacattactttttttttctaagcagccttcgaaacgccgtgtgcctcttccacttgacagcatgtctccatttggactggccacattctcaaaagccgcaagtggctgaggactgccacggaggccacacagctccagtccattctactggttgttatgagttcagtgttagtgccgcccccaccccccaaaatttgcatgttgaagtcctaacccccagtgtgatgggcttggacatggggacgtcaggagataatcagggttcggtgcaatcctggtgatacaaccctcgtgctgggacgagtgccctcatgagaagaggccagaggacttgctctcctgccacgtaaggacacagtgagagggtggccgtctgcagcccaggaagaccctgacctgctggcaccccgatctcagactcccagcctccagaactgggggacatgactgtctgttgtggaaactcccagtctgtggtattttgccacggcagcctgagctaagacactggctttgcatggcgagagcctgcagatgatccagcaaaaacaaactgtccctagcaggcctggggcaagggggaggaccgagcagaccccatatccagcatcacagggttcgtgagtgagctgttatgcttggtgttgtgtgcagagattaaatgtccacagtctctgagttcacgaggcttatcatgtcatgagggacaagacgataactccggtttatgcctgcgttactactttacccactttctgtgcgcatggaaaatgacaggagagcacagaaaagcacccgtgtagcccagagatggacacaagtgctaaggaatccagatggaaatggaatgacttcggagtagggtagaaagaacctactgctactattatctactcttgaaaacctaaaaggttcgggggttttttttgaaaggcctctcccagcacagataggaattgtgtccatagtcaagggtcactccagcttctgatgctgcagctaatatgattggacttttgcccagattgtttcgaattgcccctgggccacatattaatttgtttcagatgctaccttttcccactgttagacataaaagaatcaaagtgaaaaaacaaagatgcaaagccctgggattgttaaaaagttaattgctcagtgttggcctaaatgacagaaaagtccccaacttcctcaaggtcagaattttacgtgtaaaaaaggaaaccttgagaatttagaaaacacttgcctcaaataagcatcattagccattgcaccagtggcttctacacaccaggttaagccacatcaaagaactcccacgctcctagacccagaaaaatagaagaaaataattaaacaaagtaattggaagcgcctggcaaggtcaaagtaccaggaaatgtccttgagtaaaaagaagcctgggactaagctgagcacatctaaaatctctcatatccaaagcctgtattttccttggcacgggagatggagaacttgatcctgaccattgacaaggaggccaggaggctaaatccgccacatgcaggcttcctcctaataccctgacgggacttccggcttctgtaaacttctgtgggaagtaggcacacgccgacttggggaaagttgaccagggtaagcctagaggagggacaatattataaactgtgtggaaggtcccctgagacgttcacagactcagagggaggagcggcagtgcggacttgaaagcaatccaggcggagctgccaagaggcttagccacaagcacggatccagccacagagctggggcgaggctgtgaggagcaagccgagccatggcatgccgctcggtggtgggggaatctggcggcactgtccaggaagagcccctctgcctccccggaaagctcccaccgatgatccactgagatgcacagacacgacccagaggccggctgggctgatcccacacgtggctggtggccaagggactcagccgtccacacccagccacacacaggaggctcgtcctatgagaccctcctaggatcctcgctcctgatgtgtcctcattcggcctgagcagtcgcggccatctcgcctcaggctgtccccatcttgcctcctacccacccccacggtctcccactggctcgagcccctgccctccccaggtcacttccaggtctgtctccatctggctgtgccactgtgctcccaaggcctccccagggagccgtccctgcaggggacatgtggcatggttttgctttgtagtcgtgatcttggagagagacactatgccctaatctcaaagacagtccctaaggctgtgaatgtcaggcccttaccaggcctggtggtagcaactatttcagagtaggcacattctttgggctccttccaaccacacgcatgagtaacactgggcctgcccagggtgaagatccagtggaagacatcatgtggatgaattcaagctggaaaataatcccaatgacatgaatatttcaacctaaactttgatttgtaccacaattatattttttctgattacaaaagtaatgcaatggcattgtaagggattaaagccttgttttatatgtatataatttttttttttttgagacggaggctcgctctgtcgcccaggctggagtacagaggcgcgatcttggctcactgcaagctccacctcctgggttcacgccattctcctgcctcagcctcccgagtagctgggactacaggcacccaccaccatgcccggctaatgttttgtattttcagtagagatggggtttcaccgtgttagccagggtggtctcaatctcctgaccttgcgatccacctgcctcggcctcccaaagtgctgggattacaggcgtgagccaccatgcccggcctatatgtatataatttttgtagacttgttctttcaatatacctccaggaagaaacacagcctaaatttacatgaatatgtttctggacttctttcttctcctcctcctcctcctcctcccctcctcctcctcctcccctcctcctcctcctccttccctcctcctcctccttccctcctcctcctccttccctcctcctcctccttccctcctcctcctcctcccctcctcctcctcctcccctcctcctcctccttcttcttcctcctcctctctctctctctgtctctctgtgtctctctctcttctctgtgtgtgtgtggatgtgtgtgtactcacacaacagagctctggagatgcatgcagcacacgcatatgtagatataaccactataaggacaatatcctaagagctgagtgtccaggtcactgattttcctttccttgtttcgttgcaaactcagggtgtcacacctgggccgtgtggaggctgagggatgggtgaggacagatggggatgggcaccctgctgttgtctgagggccgtcagcaagtctctcaattggtgatacgtatggacctgggtcctcatgagagccatcctaatcttttctcagtgatgcaacaccgtctgtttccatgccatcagtcttattacaggatgatggccaaggagctcatctgaactgccaggtgaacagtggggccctaccacatccccatctacccatagcttggtttgggttcacggtgccaaaatcatatccccaagttatagtataggctcattgccaagggagttttcttgtaaacactccctggccctgggaacccttctctgacctaaaggaggcatcgctggactaggttccgggtaatgcaatcacctagtgacccgtgtccccagcctgttctcaggtcctttgcattttcctcaatgtccttcctgctcatgccctcaggcccctgcttttgggatgtgtggccagcaagcccagtgcaggaagtactgagctgccgactgccactccacagaatcacaggacagagcctcccagaggcagtaagtgcagcgtgggctggaggaggccacctgctccgttgtgatgagggctggcctctgctgtgctttgatttatgagcaatcatgtgttcacaaagtacctactactatgtgaccagtgcagcagccagcagggtctgcataacagtggctgcaagctctccacccagactcctgccctcgtccatggggatgaggttggggcagcctccatgcagttagcacctccttccactctccccctccagccagcaggagccacagtgggccacaaggaggactctgccctgaaagtggcagatcccagcccaggagaacctgggtccctggacggcagcctgggcctgcacccctgacccgggccggcccccaggagctgtcttgtcagcgagcagcacccacgttttcaggtttcagcagcttagctttatcctgaccgatgcttggcactcaggacacgcatctgctatccctgctctccactcccctaaatcttgaggaccggtgtcctctcggttatagcctaaactacaagtgtcatcatcgtctctgtgcgtcggtggtcaggaagtttgattgtagaatatcaggatgaaacctttccgccagcctcgttttccctggacgtgatgtctggagtcagagttaacaagtctcctgcttcctggctggaggctgcggtctttattcctcagaagggggcccagaccgttccactgttgacattgtgtcttcgcagacggctcagtggctccttcaggctgtgccctgctgtgaatctcagcctcgactccagcctggtgcaggggtgcagggcacagagcacacgccacacagtcaccgcaggccctgaacccagtggaacctgccctgtggggctggggtgttgcttaggacccgagacagcgtcttccctccagtttctcccctttggaaggggactggctttcttctgcctgtcccaccatggcatttgggaagcagataacctgttttccagacagaagatgccacaccctgtgaagacatagactctcagggagaagaccccagaggacagaggcagggctgggggtgacatgtccacagccaaggaacaccaaagacaccaagccaccatagtatgccagtagagaggcctggaacagactctccctcccaccctcggagggagcctgccctgccgacaccttgacttcaaacttccggcttccaggatgacgagagcatcagttgccctcactttaaggtctcaagttctgtacattctgcacattcccagaaaaggttggtcacagcagcctacagtatttcagtttagcgtattcttctgtgttcagtgcatattcccaacacggtctagaacgccctttacttcacaagcacaattccatagtaaaacttaataatggtgctctgggccaggccatttgatctggctggactgtgttccctggctgtgccctgaatgtgtcacctgcagccacacagggcgccctctcattcttgcactgacccagctcctaaacagcagctttccagcagtggttcctggacttccagagagcttttctgccacagtggacattgccatcctttttttggccaccaggcatctgaaatccttcccagtgtttggtgaatcctccaactcgtgacacaggatctgaacgtagctacactacattcagaaagtgcagaggccagcactcgctttgcccacaggggcactcgcacccatgagcctagctgcaagcctaccctgccgggaagctagtgactcccagaactcagacggctcagacaccaccctggatggccacgccgttcccatgggcagaggtgtcagcaggtctagcggcagcctgcagcctctagcctgaggtcccttctgtgtgtgcagccagtagtgctggtggtagagacttccctgagcgggtcccagtgtcctttttcccagcatctttctcgctgtggtaggctaggaaactcgttctcctccccacgccacctccattccttgagctagacaatatataattcttttaataatcgctttaataatttaaaggaatatttaaatactcttttaacaattccttttctgcttcagttacccagagctgtgttctgccacctcccactgagaaccgtaagtggttctttcctccgtaagcacatactcctgtttgacatgaaaatgtcagcagagatttttcggcgtgatctaaagaatgcgatcttggcggccgtctaccacacaaggaggagggcacgtgtggatttcctggccttgcacagttggtgatgaaagcggagttgcctagtgatcagctgacttgtgatcaattacaataatgatggaatttcaaggtcaatgtcgtgctggtttttttttttttgcgagctcatcttttctgcttaaggagaaaatgctagataaatgcatctccatgtgggcctggacctctccatgttgctctgtcttgtctgtggatgtttgacagagaccggaagacctgcagaccagcctgccaacaccgtctgtcaatggggtgccactttcacggccctccccttcccatcagccttagcccaaatcaccctccaaaatcaccaaccataggaaacatctttaatgtaaactaattccttcacactgaaaatgtttacaatttagctgggtgcggtggctcacacctctaatcccagcactttgggaggctgaggcgggcagaaggcttgaggtcaggagttcaaaaccagtctgagcaacatgacgaaaccctgtctccacaaaaaatttaaaaaattagctgaacatggtggcacatgcctctggtcacagctacttgggaggctgaggtgggtggattgcttgaagctgggaagttgaaactgcagtgagccaagattgcaccactgcactccagcctgggcagcagagaaggaccctgtctcaaaacaaacaaacaaaaaccaaaaatgaaataaaatgcttactgtcggccccctttctctgcagaggtccagatgaggagcctctaatcaaggtggtgactgggccacacagccacgcccttccctcggggtgagcccttccctaggggtgagcccttccctggggtgagcccttccctcggggtgaatctttcccttggggtgcacccttccctcggggtgagcacttccctctgggtgcagcctttgctcggggtgagcccttccctcgggttgagcccttaccacagggtgcgcccttccctaggggtgagcccttccctcggggtgaaactttcccttggggtgcgcccttccctcagggtgagcacttccctctgggtgcagctttggggtgaacccttccctcggggtgcagccttcactcaagggtgagcccttccctgggggtgcagccttcgctggagggtgcatcctcccctcggggtgcgccgtggcacatgttgcctctccactcactgctctttcttggctgcctccttcctggtgagtcctttcccgctgttgctcactatctgcggatttctgatcacttgtcttccctcttgagcttggtgaacagaccaggaggagggcacaggatgacccccatggctccccgaacatttctaagaccaaaaccaaaaagcccaaggggagaggaccggaccccactcagggctcagaaagctgatgcctggcgccccgcagtggcgtggggtggtcttgcgtggctgtggacccctcaaccaggcaggcgagagcagggagggaagtgggtacaagtgagcaagtgtgtgagtgtgtgggagtatgactgttagtgtgtgtgtgtctgagtgtatgtgtgactgtgtatgtgtgtctgagtgttagtgtgtgtgtgagtgcgtgggagtttgtgtgtctgagtgtaagtatgtgtgtctgagtatatgtgactgcgtatgtgtgtctgagtgttagtgtgagtgtgtgtgtctgcgtgttcgcgtgtgtctgagtgtatgtgtatgtgtctgagtatgtgtgactgtgtatgtgtgtctgagagttagtgtgtgtgtgtctgcatttagtgtgtgagtgtgtgtctgagggttagtgtgtgtgtctcagtgttagtgtgtgggagtgtgtgtgagtgtgagtgggtgtctgagtgttagtatgtgtctgagtgttagtgtgggagtatgtctgagtgtgtgtatctgttagtgtgtgagcgtatgagtgtgagtgtgtgcatgctgggaagagacatgggctaagaataaaacactttcccagagtgtagcaaataatagcaaagttcacccatcagttctcctgccttaagcaactatgggctttcactcttcaactttcttctctctctctctctctcacacacacacacacacacacaccatgagacctcttctgagctctcctggcaaggttgggctccctgctgcccccatatcccctcacttacaccaagttccgtccccctgactggaatgtttggggtgagagcccctcctttgtcctatttgcaccagcgtcagctgaacgtgttaggaagtgtgaccgccgcctctcatggaccccagaacaacctcctgttcgcacaggggcccactcctaatcttctggagttggcatcatgggagatgaccaaactctcctgaaaagtcttgcgcagtaccatgatcaataaaactaggagagtataacagaacgctctgaatttggagccagaaaaccttgattcaggtccttcatgtggccttgggcaaatcacttaacctttctgagcctgtaccctcaaccgtatcttcctgtttcttaagatcaatgtgaggtttaatgataaataactcttaaaagggctttgcatcatgcttgggcattttggctattcaagaacctcgcgctgcatgaagaaagatgcattctgtgtgactctggaggcttttcgagcagagagaaacagcaggttcacaggtaagaaccaggaaggccatgtgggctgggaagatggtgaggcagctttgaatgcagcagtggtgtgggggcacagggtagggggaggttagatatgcaactgacttcagagtttccttctcagcttccctggatgggagttagtgttaggatcataagtcagaatacaattgggatcgtagaaatttcccaattctagtcactctgtgctcaggtacaactacttaagcacgatcattgtctcggtccaggacacatccattcacacatgcacacacacacgccatgtgtgcacacataggtatatacaagcattacatgcacacacccccacatgtatatacacatatagacacacatgcacacacccacatgtgcatgcacacacccataaacaggcacacacgtgtgagcacaggcataaacatgcatacacttacgcacacacatgcatacatgccccttaaactcactgcagagtctgaagagaggttgttgacttgaggagcagcactgtgcgtttaaatgaggcaaaagaaagttgaccacccccagcctgaccaggagttgtggttggccaggaaaataatatttggagctcatgaataaagaagtcatgatgactgagatgggggcactcgtctccacccaaggcacctgccaggcagttgcatcactacctcgcccctgtgccccagggctgtgagccctcctggctgccagcagtgcctgaactcagaaccaacaggaccttggggcacagctccgtggccctttcagtgaccgccctcttcttcctcttgcagccctcggcttgttcctcctcctgctcacacttcacccttcaccctggctgacctgcgtgtgccaaacacggttgtgagctcccacagaacgaggagaggcagcccgttccgctgcatctccccagggcaccggcaaggacaggcaaagcctcgttgactgaattcacggagagcagagactgcgcccaggcctcgaccccaggacttctgtgttgtgtgagacgtgctagtgatgccgctttaagctctgctttgaaaatggtcctttgacagattctgaatgcaagtggcctccttacgagatcctgcagaataacaaggacaacttatcacaacttcctcattgtaaaatccagctcagattgcagttgaagatcacaaatgctctctgtttcactttgcgatgtttgtggtgtctaatacagcaacacaagcctaggtttctgtgcaaagacttccttattgtttatttactatccacttcctctgagcaggactgatcgacttttcacttcttaggcccctggtgggtggcctaacattgggaacgtctctgggaatcaatggcctcccatgctattgccctaagaggaaaaactatggacccatttccggctcgtgagttggaagtggaggtctgctggcggcctttgtctccctgccttcccctcctgtcactggctggaacatgtgcttgatgcctggcgttcagcagccctgttgaaactgtgaggtgactggcaggtgtcagaaggaaagcaaactgcctagtgacggcagaggctgcatgcactccactgccctctgctccactgtccactcacctccgctggctctgtgccccaaggccctggcctctatggccggcatccatgggcttccctatcctctggcctccaggtggattcagtcacagcagaagctgggaggggcagctggaggttggagaaacatgaggctagtgtccagttccctccctggccgaggcagccgtggaggtgctcctttccaggaagccagcactcctttccggtggtcctgctctgaccacggcagctcgagctgagcacagagtgacggctacagctccctccacatctggcctggggtgggaacagctcctggatgcttcttcttcctgtgctggcatcccttagtccctcccacctttttttttttaatataataaacctgctttgttcaatcctcctcaaccacccactgaagcaagccctcctttccttgccgggacccagagagctgctgggaaagaaagggtgggccccccgcagtgtggtcagcacctgggcagaccccacccaccttctatgatgaaagccctggatggattcctatccccaccctgagctcctcccctaactccccaaaacattgggaagatgggccttctgtcctggaagggccagtctcctgggcagagcgc

SEQ ID NO: 70 - DNA, 5838 bp, Homo sapiens
aaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 71 - DNA, 2877 bp, Homo sapiens
acttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 72 - DNA, 1656 bp, Homo sapiens
tccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 73 - DNA, 7272 bp, Homo sapiens
aaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagcttctggctgctcagtggacgcttctgccaatgctcacagccccacaggcctgggcccgggagcctctgctgccacccgtggtttctctccctgttccaccatcggaaccccgtgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgta

SEQ ID NO: 74 - DNA, 7673 bp, Homo sapiens
acaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgcct

SEQ ID NO: 75 - DNA, 2249 bp, Homo sapiens
gcaggaatagaaaaatacggatagccgaaagatcattcttacgttctacttaatatctcctatggagaaagtgtggctaatgaatttttttttgttttttttctgttgttgctcttgttttgttttttgagacagagtctcgctctgttgcccaggctggagtgcactggtgtgatttcagctcactgcaacttttgcctcccgggttcaagcgactctcttgcctcagcctctcgtgtagctgggattacaggctcccaccaccacacccgtctaatttttgtattttcagtagagacagggtttcaccatgctggccaggctggtctcgaactcctgggctcaagcgatctgcccgcctctgcctcccaaagtgctgggattataggcatgagccatcgtgcccgaccctgctaatgcaatctttataaaactttagattcctagattttaaggagctgtaaggaacgtacccagaagtcagaacccaggttttagtcccagcacagatcatagctagctctgcagcctccagagtcagctggcgtctaacagtccttcaataatcctggtctaggagtggttgctggggaaatggtcagcccagactgtgttccagaattatggagggccctgctcgacccccaccctcagactctccgcaaatgatctcaattcttcctctgcgaaagcacaagttatctgccgggcgcggtggctcacgcctgtaaccacagcactttgggaggccgaggtgggcggatcacccgaggtcaggagtttgagaccagcccggccaacatggcgaaaccccgtctctactaaaaatacaaaaatcagccaggcgtggtgacgcgcgcctgtaaccccagctactcgggaggctgaggcgggagaatcgcttgaactcaggaggcggcggttgcagtgagtcgagatcgcgccactgcacactccagcctgggggacagcgagacttcgtctcacaaaaaaaaaaaaaaaaaggaagaagaagaaaacagaagctgtctagcaggaatccctgcaagttcctgcgctctgcctctactccaccctctctgcaaagatctctctcagctcctggcctcaccggttccccttattttcataggaagaggcatttgtctgccattccgggctccccgccagctctctccctgctcacacgccatccccatctatcagtgtccccctctctctccctggaggttcttctcttacttcccaccctctttcctgttcgtcagcgcctagatcctgcagtagtctgccctgcagtctgcgctttcagacctccggaccctcctcggacctcggccagacctccagacccctcctcggacctcggccagacctccggacccctcctcggacctcggccagacctccggacccctcctcggacctcggccagacctccggacccctcctcggacctcggccagacctccggacccctcctcggacctcggccagacctccgggccctcctcggacctcggccagacctccgggccctcctcggacctcggccagacctccggacccctcctcggacctcggccagacctccggacccctcctcggacctcggccagacctccggacccctcctcggacctcggccagacctccgggccctcctcggacctcggccagacctccggacccctcctcggacctcggccagacctccggacccctcctcggacctcggccagacctccggacccctcctcggacctcggccagacctccgggccctcctcggacctcggccagacctccggacccctcctcggacctcggccagacctccggacccctcctcggacctcggccagacctccggacccctcctcggacctcggccagacctccggacccctcctcggacctcggccagacctccgggcccctcctcggacctcggccagacctccgggcccctcctcggacctcggccagacctccgggcccctcctcggacctcggccagacctccgggcccctcctcggacctcggccagacctccgggccctcctcggacctcggccacgcgcccgctgccacacgggggcgctgaccctgctccgccgaaggtcattcgcggccgccgagccgcccggccccgcaggcacgttgcgctctcctcccttgccgcgtttaatgtctcccagttgaccactccgcttctgctctcccctccctctgttaggggtcgtcg

SEQ ID NO: 76 - DNA, 3620 bp, Homo sapiens
gcaggaatagaaaaatacggatagccgaaagatcattcttacgttctacttaatatctcctatggagaaagtgtggctaatgaatttttttttgttttttttctgttgttgctcttgttttgttttttgagacagagtctcgctctgttgcccaggctggagtgcactggtgtgatttcagctcactgcaacttttgcctcccgggttcaagcgactctcttgcctcagcctctcgtgtagctgggattacaggctcccaccaccacacccgtctaatttttgtattttcagtagagacagggtttcaccatgctggccaggctggtctcgaactcctgggctcaagcgatctgcccgcctctgcctcccaaagtgctgggattataggcatgagccatcgtgcccgaccctgctaatgcaatctttataaaactttagattcctagattttaaggagctgtaaggaacgtacccagaagtcagaacccaggttttagtcccagcacagatcatagctagctctgcagcctccagagtcagctggcgtctaacagtccttcaataatcctggtctaggagtggttgctggggaaatggtcagcccagactgtgttccagaattatggagggccctgctcgacccccaccctcagactctccgcaaatgatctcaattcttcctctgcgaaagcacaagttatctgccgggcgcggtggctcacgcctgtaaccacagcactttgggaggccgaggtgggcggatcacccgaggtcaggagtttgagaccagcccggccaacatggcgaaaccccgtctctactaaaaatacaaaaatcagccaggcgtggtgacgcgcgcctgtaaccccagctactcgggaggctgaggcgggagaatcgcttgaactcaggaggcggcggttgcagtgagtcgagatcgcgccactgcacactccagcctgggggacagcgagacttcgtctcacaaaaaaaaaaaaaaaaaggaagaagaagaaaacagaagctgtctagcaggaatccctgcaagttcctgcgctctgcctctactccaccctctctgcaaagatctctctcagctcctggcctcaccggttccccttattttcataggaagaggcatttgtctgccattccgggctccccgccagctctctccctgctcacacgccatccccatctatcagtgtccccctctctctccctggaggttcttctcttacttcccaccctctttcctgttcgtcagcgcctagatcctgcagtagtctgccctgcagtctgcgctttcagacctccggaccctcctcggacctcggccagacctccagacccctcctcggacctcggccagacctccggacccctcctcggacctcggccagacctccggacccctcctcggacctcggccagacctccggacccctcctcggacctcggccagacctccggacccctcctcggacctcggccagacctccgggccctcctcggacctcggccagacctccgggccctcctcggacctcggccagacctccggacccctcctcggacctcggccagacctccggacccctcctcggacctcggccagacctccggacccctcctcggacctcggccagacctccgggccctcctcggacctcggccagacctccggacccctcctcggacctcggccagacctccggacccctcctcggacctcggccagacctccggacccctcctcggacctcggccagacctccgggccctcctcggacctcggccagacctccggacccctcctcggacctcggccagacctccggacccctcctcggacctcggccagacctccggacccctcctcggacctcggccagacctccggacccctcctcggacctcggccagacctccgggcccctcctcggacctcggccagacctccgggcccctcctcggacctcggccagacctccgggcccctcctcggacctcggccagacctccgggcccctcctcggacctcggccagacctccgggccctcctcggacctcggccacgcgcccgctgccacacgggggcgctgaccctgctccgccgaaggtcattcgcggccgccgagccgcccggccccgcaggcacgttgcgctctcctcccttgccgcgtttaatgtctcccagttgaccactccgcttctgctctcccctccctctgttaggggtcgtcgcgcttctccgatttctccacgaactttgtgattattcattttgggttttcattcctggcttttctttatctgcctcgcttcaaaatcatgacactcctacgtaccctgccatcacttctgcctcccagacctgaatgaataactgcccgtttccggtcacctttgtttcctgtctgggcttttccgagctccagacacaaatatccagttgctaactagatatttcaaaaccatgccccttcatccagttcttcaaatttactggcatgaagttcacagtacccacttacgattttttttaaaacctcatctgtgtatttatatttcttatttctgatattatttgacttcgtctgctagaggtttgccatttcaaagacacaccttcagccctgctcatctctatagtatttttattttgttttgtttttctattttatttctgctcttatctttattattttcttccttatttatttggttttactgtgttgctctagggttttgctttgttttagatgaatgctgactcatacggatgagtaaatttgcttacttttttgttgatggagcaaaggattgtggtagatatttgtttttgttctggagtatatgagatggagcaggaatcccgtttttaggggattgcggacctccaagccgggaaataaaggaaaatcttgagttccttgaagggaaattccaggcacccaactagccttgagaagtaaacaacttgataagcaagaagaatagtagcctgaaacaatagccaaggaagttagagtcaggatatggttggttcccctatagaaactaaagataacattttatcttaacatatgtccctgagctgtttacagaaacccagacccccaccaaatggatctgctggcacagagacctcagataaggggaaactgaggactgaactccaatcaccattctttgttctaaatttttcctgagaggcttagagggagtcacacccattagccagagctaacattcttttccgccaaccctaaatttttgcataaaacgtctcctctctttgcatctatgacctgtaagtccctacttcaagatatcctgccctttcaagccaaaaccaaagtgtagcctccgtgtactgatgtacgattttgtctgtaactgctgttttcctgaaatttacccctgcctttaaaaaccctgacctccaagccatcaggaatgtcaggatttgaggattagctgtttggtcctccttgcttagagcccctgcaaataaatgcctttccttctaccgctgcacagcctcagtgtgaatatctggttttactgcgccaggcaagcagacccctgttcgcttctattacatgtccacca

SEQ ID NO: 77 - DNA, 7426 bp, Homo sapiens
gcaggaatagaaaaatacggatagccgaaagatcattcttacgttctacttaatatctcctatggagaaagtgtggctaatgaatttttttttgttttttttctgttgttgctcttgttttgttttttgagacagagtctcgctctgttgcccaggctggagtgcactggtgtgatttcagctcactgcaacttttgcctcccgggttcaagcgactctcttgcctcagcctctcgtgtagctgggattacaggctcccaccaccacacccgtctaatttttgtattttcagtagagacagggtttcaccatgctggccaggctggtctcgaactcctgggctcaagcgatctgcccgcctctgcctcccaaagtgctgggattataggcatgagccatcgtgcccgaccctgctaatgcaatctttataaaactttagattcctagattttaaggagctgtaaggaacgtacccagaagtcagaacccaggttttagtcccagcacagatcatagctagctctgcagcctccagagtcagctggcgtctaacagtccttcaataatcctggtctaggagtggttgctggggaaatggtcagcccagactgtgttccagaattatggagggccctgctcgacccccaccctcagactctccgcaaatgatctcaattcttcctctgcgaaagcacaagttatctgccgggcgcggtggctcacgcctgtaaccacagcactttgggaggccgaggtgggcggatcacccgaggtcaggagtttgagaccagcccggccaacatggcgaaaccccgtctctactaaaaatacaaaaatcagccaggcgtggtgacgcgcgcctgtaaccccagctactcgggaggctgaggcgggagaatcgcttgaactcaggaggcggcggttgcagtgagtcgagatcgcgccactgcacactccagcctgggggacagcgagacttcgtctcacaaaaaaaaaaaaaaaaaggaagaagaagaaaacagaagctgtctagcaggaatccctgcaagttcctgcgctctgcctctactccaccctctctgcaaagatctctctcagctcctggcctcaccggttccccttattttcataggaagaggcatttgtctgccattccgggctccccgccagctctctccctgctcacacgccatccccatctatcagtgtccccctctctctccctggaggttcttctcttacttcccaccctctttcctgttcgtcagcgcctagatcctgcagtagtctgccctgcagtctgcgctttcagacctccggaccctcctcggacctcggccagacctccagacccctcctcggacctcggccagacctccggacccctcctcggacctcggccagacctccggacccctcctcggacctcggccagacctccggacccctcctcggacctcggccagacctccggacccctcctcggacctcggccagacctccgggccctcctcggacctcggccagacctccgggccctcctcggacctcggccagacctccggacccctcctcggacctcggccagacctccggacccctcctcggacctcggccagacctccggacccctcctcggacctcggccagacctccgggccctcctcggacctcggccagacctccggacccctcctcggacctcggccagacctccggacccctcctcggacctcggccagacctccggacccctcctcggacctcggccagacctccgggccctcctcggacctcggccagacctccggacccctcctcggacctcggccagacctccggacccctcctcggacctcggccagacctccggacccctcctcggacctcggccagacctccggacccctcctcggacctcggccagacctccgggcccctcctcggacctcggccagacctccgggcccctcctcggacctcggccagacctccgggcccctcctcggacctcggccagacctccgggcccctcctcggacctcggccagacctccgggccctcctcggacctcggccacgcgcccgctgccacacgggggcgctgaccctgctccgccgaaggtcattcgcggccgccgagccgcccggccccgcaggcacgttgcgctctcctcccttgccgcgtttaatgtctcccagttgaccactccgcttctgctctcccctccctctgttaggggtcgtcgcgcttctccgatttctccacgaactttgtgattattcattttgggttttcattcctggcttttctttatctgcctcgcttcaaaatcatgacactcctacgtaccctgccatcacttctgcctcccagacctgaatgaataactgcccgtttccggtcacctttgtttcctgtctgggcttttccgagctccagacacaaatatccagttgctaactagatatttcaaaaccatgccccttcatccagttcttcaaatttactggcatgaagttcacagtacccacttacgattttttttaaaacctcatctgtgtatttatatttcttatttctgatattatttgacttcgtctgctagaggtttgccatttcaaagacacaccttcagccctgctcatctctatagtatttttattttgttttgtttttctattttatttctgctcttatctttattattttcttccttatttatttggttttactgtgttgctctagggttttgctttgttttagatgaatgctgactcatacggatgagtaaatttgcttacttttttgttgatggagcaaaggattgtggtagatatttgtttttgttctggagtatatgagatggagcaggaatcccgtttttaggggattgcggacctccaagccgggaaataaaggaaaatcttgagttccttgaagggaaattccaggcacccaactagccttgagaagtaaacaacttgataagcaagaagaatagtagcctgaaacaatagccaaggaagttagagtcaggatatggttggttcccctatagaaactaaagataacattttatcttaacatatgtccctgagctgtttacagaaacccagacccccaccaaatggatctgctggcacagagacctcagataaggggaaactgaggactgaactccaatcaccattctttgttctaaatttttcctgagaggcttagagggagtcacacccattagccagagctaacattcttttccgccaaccctaaatttttgcataaaacgtctcctctctttgcatctatgacctgtaagtccctacttcaagatatcctgccctttcaagccaaaaccaaagtgtagcctccgtgtactgatgtacgattttgtctgtaactgctgttttcctgaaatttacccctgcctttaaaaaccctgacctccaagccatcaggaatgtcaggatttgaggattagctgtttggtcctccttgcttagagcccctgcaaataaatgcctttccttctaccgctgcacagcctcagtgtgaatatctggttttactgcgccaggcaagcagacccctgttcgcttctattacatgtccaccatctgaatccccctactatgttttggtaatttcccatcacaggagtattgatgagaggcagatgtatcctcccactagagaagcaaaacagctagatatttgctgtctccacttatcaaagtatagaattttaagttgccagttattacctcgcaacacatttagcttctgacatgtattgttgctgaagaaaagtccgatatgaatcagaccttccagtgggacaagatgtggagatggaagacaatattgatgatcctgaccctgtgtaggtctaggctacacttttgacagctggtgtcaaaagtattgcgtgactgtgtgtatgtctttgtttttaacaaaaaagcttaaaaagtaaacaaaataaaaatttaaaaatataaaaaggcctatagaatagagatataaaaagaaaatatttgtgtacagctgtacaagatttatgttttaagccaagtgatttacaagagtcaaaaagttaaaaacaattaaaaagttttataaaaagttatagtaaactaaggttaacttattattatgaagaaagacaaaaattttaaataaatttagtgtagcctaagcatacaatatttataaagtctacaggaatatgtagtaatgtcctaggctttcacattcactcaccactcactcactgactcacccagagccacttccagtcctgcaagctttattcatgttaagtaacctattcaggtgtaccatttaaaaaaaaatcttttatattgtatgaaagtataaaaatatatacttctatatatttttaactttttctgtctttagatatatttagatacaaataccactgtgttaaaattgcctacagtattcggtacagtaacatgctgttcaggtttgtaacctgggaaccataagctataccatatagcctgtgtgtgtagtaggctataccatctagaattgtgtaagtacactctatgatgacctcacaatgacaaaatctcctaaggatgtgtctctttttttttttttgagaaggagtctcgctttgtcgcccaggctggagtgcagtggcgcaatctcggctcactgcaagctccgcctcccgggttcacgccattctcctgcctcagcctcccgagtagctgggactacaggcgcccgccaccatgcccggctaatttttttgtattttttagtggagacagggtttcaccgtgttagccaggatggtctcgatctcctgacctcatgatccacccacctcggcctcccaaagtgctgggattacaggcgtgagccacagaacctggcccaaggatgcgtttcttaaagcatacccccttcactaagctccaagtgactgtatattttcacacctttattttggcctcatgctgggtggagtcatttcctgcttctcggctttgggcttgtccatattacttgctttgaccatcatgatattgtgaaatacacatttggtcttcatcctgtttcctagcatacagctgctaaaatccctggaatctctggagtgataagagtatcttttgtatgcaaatgagatgactggtggctgggggcccctgggtagcttcaggataggggctggtcaccagaaagaccaagacaggattacagggttgggacattgagccctacttccaatctctgggcaggcgagaggggctgaaggttaagttgatcaccagtggccaatgatttaagcaattgtgcctaggtgatgacgcctccataaaaacccaaaaagcgggtgggttggggatgcgtgatgggggaggttccagatagctgaacatttggaggttcctgcagggcagtgccctggagagggcatggaagctccgggctcctactcacgtgccttgccctgtgaatctcttgcatctggttgttcatctgtagccttgtcctattctttacaataaactggtaagtgtgagtaaagtgtttccccgagttctgtaagcagctctagcaaattaataaaacctgaggaagagggcacgggaaccctgatttatagctgataggtcagaagcactggctacgtctggggcttgcgattggcttctgaagttgggggcagtcctgcgggactgagtccccaacccgtgggatctattgctatcttggtagaaaatgtcagaattgaattaaattagaggaaacctagctagtgtccgctggagaatctgctgaagaattggttgcttggtgtgtgaggaaaatcccccacatatctggtgtcaaaagtgttgagtcactgtgtgagagtagagaggaggaaacagcttggttttcttctgtctcacaggcctatttggagcgacgtgaaatatgccttgctgttgggctctccctcctgttctctgatgatctgtcacgagggggatatgaacaactgctgtccccagagcctgggcccccgaatgagaaatgtgaagcagaccacgtggcctggtagcatttggtcccagagggatgagacagacacccatgggccagaattgaagccaacctggggcctagggcctacagcccagaggctgtgctaaagcctggagtccagccaaacccagcgaagtgacagcctgccagcagccccatgttcctgagagtaaacagttataacagttgaagcttctgaattttgttacacagcgttgttgtggccatagccaactaatgccttatactttatttagttttcttcatgtttggagatatttggtttgcaggtttattttgaatgtgagagtttttgtttgtttcctcttctctgtgcttatcactgcctgttagtacatttcagaaaccttcctgcaggcctcctgggccttgtgtccagagctaagtcttacgtggattcttcatgtcctatcgccggttatagagggaatagtcctccagccagagtgtgtgttggcccaagtactgggtgtgagctgtgtttgcatctttctctctctctaggtatgaagctcacataggtggaggcccaggtggcaggtggttgaagcttgaagcttttctcagtttccattgatgcaggagtaagggtcagcttggctcgcttagtttctgccttgcctagggttcttttagtcctcatcaccccacaggacaccaactccatgtccacctagttccacacctggacgcagcaggtcacagcttcagtcttgcttgtctttctcttctgtatgtagtccaatgctctgttcaccttgctttttttcttttgagacagagtctcactctgtcgcccaggctggagtgcaggggcacaatctcggctcactgcaagctccgcctcccgggttcacgccattctcctgcctcagcctcctgagtagctgggactacaggcgcccgccaccacacccggctaattgtttgtatttttagtagagacggggtttcaccgtgttagccaggatggtctcgatctcctgatctcgtgatccacccaccttggcctcccaaagtgctgggattacaggcgtgagtcactttccttctgagatgtaaatgtcttttcagtttttctgagtatattttcgccgtcaggttgtgtgtttcaggtggaaagggggagtgtattgcatgaactcatgaactcacaatgctattccaaccagaattcccctggaatttctacttgcaggttcaccaaacacttgaatttcatatactcaaaacaaaactgaaattctaatcatgtctttccataaaaccactactttctggattctgtattctggttaatattcccatcctcttttcatttgctga

SEQ ID NO: 78 - DNA, 5149 bp, Homo sapiens
tgcagacatacctccttctatatagcacatcactttattgatcgaccataagattcatggtcgatcaataaagcaatggttcatgaagtttgatgaaagaagtttaataaaagaagccattgccatagcatagaagtgcaaggtgaggcagcaagtgctgatatagaagctgtggcaagttatccagaagatctagtgaagatattgatgaaagtggctacactaacaacatattttaagtgtagatgaaatagccttctattgtaagaagatgctgtctagtactttcatagctagagaggagaagtcagtgacgggcatcaaaggataggctgaccctcttgttaggggctaatgcagctggtgactttaaattgaaaccagtgctctttcaccattctgaaaaatctgagggcccttaacaattatgctaaatctactctgcctgtgctctataaatggaacagcaaagtctggatgacagtacatctgttgacagcatggtttactgactattttaagcctactgttgagacctacagctgagaaaaagaagattccttgattcaaaatattactgcccattgacaatgcaccaggtcacccaagagcttagatggagatggacaaggagattaatgttttcatgcctgctgacacaacatgaatactgcagcccatggatcaagggataattttgactttcaagtctgattatttaaaagaatacatttcatgaaatggtggctgccataaatagtgattacgctgatggttctaggtgtagtacattaaaaaccttctggaaaggattccccattctaaatgccactaagaatattgatgtttcatgggaggaggtcaaaatatcaatattagtaggagtgtggaagaaattgattccaattctcatggatgactttgaggggttcaaaacttcagtgaaggatgtccctgcagatgttgtggaaatagcaagagcactagaattagaagtggagcctgaagatgtgagaattgctgcaatctcttgataaaacttgagcagagaagagttactttttatgaatgagcaaagaaagtggtttcttgagatggactctatcttggtgaagatgctgtgaacattgttgacaaccaaggatttagaataatccataaacttgttgacaaagcagtggaaaggtttgagaggattgactccaaatttgaaagaagttatactgtgggtgaaatactatgaaatgctatcaaatagcatcacatgctatagagaaatatttcatgaaaggaagtatcaattgatctggcaaacttaattgctgtcttattttaagaaattgccacagctgccccagtcttcagcaactgccaccctgatccatgagctgctatcaatatcaaagcaagacccttcaccagccaaaaaattaagagtccttgaaggctcagatgatcatatgcatttttttagcaataaaatattttcaaattaaggtctgtacattttttagacataatgctattacacacttaattgactgtagtgtaaacataacttttataggcacaggggaaccgaaaaatttgtgtgattggctttactgcaatatttgctttattgcacagtctggaaccaaatccacagtatctcctaggtatgcctatatagcaaatttcttaagaatagaggacaaatcacttgcttctgattgaggttaaaatatgcccatgaccttcatttctttgccttccctccctccctgcactcctcccaaatgacttgtgaatattattttttcattctttttcattccagcagagctggtttggaattcatgatgttgaaagaatagccagtaggaacatgtggtggggtgatgttttgttggcatttaccattacagaaaatcacaagaaaattggagccattagcagcagggaaaggaaaatgagttctttatctgctgagggcatctggtgagggagggtctgtgaagatgccgcgggtgcactgctctagtatgaaatgccatttgaaggaggctcagagcacattagcgccgtcatccctgtctgatgttctcaccacacgcaagttcgtgaataattaaattgttaggaaggggaaagtcatgcatggcgggtcttgcccgaggctcaggcagacacacaatgaggtcgctactctgggagcccagtggtccaggatgccagtctggcagtgccagggaaggatgcttcctttcaataagcgaacattgtgagggagcggggtggaggcaagagaccgcttagaaatcagcacatgtgaattctgcttcaaactctgccactaaccagctatttgaccttccagaagttgcttcttcatctataatgaaggatgatgccaagaggattttaactttttgagaaataaagctcctttgagactgtaatgaaagctgtggattctttccacagaaaatggtgcatatgtctgtcgatgacatttcacatacaactttaggaagtttagaaatctttggggactcaaggatcccagcttaagaagaagtcttgcatgagatgatgtctgaactttttttgtatctctacaattgcatttttctgagactttggatcttggaaggaacctagaatgtcagctgggctctcacttctactctcaacaagaggcaagcctgccctgccagcatttcgtgcagaaggcgcaagcaacatgggagcctcctgtgttttcctcaaaagacaccatacttctttttcattagagacagggtctcagcctcgctctgttgcctagagtgcagtggcgccatgatcctcccccctcagtctcttgagctgctgggactacaggcacatgccaccatccccggctaattatatatatatatatatatatatataaatgtgtgtgtgtgtgtgtgtgtgtgtgtgtgtgtatctgtctatttatctatctatctatctatctatctatctatctatctatctatctatctatctatcgagtagagatggggccttgctattttgtccaggctagtcttgaactcttggcctcaagcgatcctcctgccttgggctcccaaagtgctgagattacaggcatgagacactgcatctggccctctataacctcttgatgtgtgcattctaagcgggaagaaacagacagcaaatgcacagtatgtatagcatgatgtcagtgatcagggctttgaaaatattgatgaagcacagtgatgccatagacagtgatggggtgaggtgctgttgtcgagttgggatggtcagataacggctctgtggaggggatatgtgggaaaagatgtgaataaaagagggattgggaccgggcgctgtggctcacacctgtcatcccagcattttgggaggccaaggtggatggatcagttgaggccaagagttcaagacaagcctgcccaacatggagaaaccccatctctactgaaaaatacaaaaattagccaagtgtggtgacacatgcctgtaatcccagctacttgggaggctgaggcatgagaattgcttgagcctgggaggcagaggttgcagtgagctgaggtggcaccactgcactccagcctaggcgacagatcaagactgtctccaaaacaaaaaagagggactgagccatgcaaatctaaagtaagaacattctaggcagaagatgtggcacagttaaggagcagtggaaagtgccaatgttcctggagctgaatgaggggagggggaagggaggagggagaggtgggagacaggttgagagactggcagagctgaggttggggtagttctttgtctactggaaacacaattatctgtactcaaatgacatctaataataatggttattgataagccacccattcatttcataggcttggttcattaccagcaatgggctgctttaataagacagtggtcctcaaacctccttctgtcaacagcacctggatagcctgctttgcagagtaccattggaatcagatatccctgtctttaaggaacttacagtacagcagaggggacaggatggtgtctccattattttgtgcacatgggagaattgctgtgtctcataagagaagcacagaaagtgccaaatagagtttcaggagaggaagtgagtactatctattggagaggtcaggaaggccccagggaacaactacgccagttttatcacccatgcactggggatggtattagaacctcccacagcattgtatagataaactgtttgagtgcctagaaagctttccacacagggcctggcacacacctagtaagtgctcaataaaatatgggcaagcatttgacttgcgtcttaaagaaggtttacgatttctgaaatataaaatgctgtctgtggccaggcacagtggctcatgcttgtaatcccaacactttgggaggctgaggcggaaggatcacttgagcccaggagtttgagagcagcctaggcaacatagagagaccacatctctgcaaaaacattaaaaaattagtctggtgcagtggtgcatacctgtagtcccagctactctggaggctgaggcgggaggatcgcttgagcccaggaggtcaaggctacagtgagctactatcatgctgctgcactccagcctaggcaacagagcaagagcctatctctaaataaattaattaattaataaatgctatctacgtagtttatcatgcagattttttagaaatacagcttccgccgggcacggtggctcatgcctgtaatcccagcactttgggaggccgagatgggcagatcacaaggtcaggagatcgacaccatattggctaacacggtgaatccctgtctatactgaaaatacaaaaaaattagccaggcatggtggcgggcacctgtagttccagctactctggaggctgaggcaggagaatgacgtgaacctgggaggcagagtttgcagtgagccgagattatgccactgttttccagcctgggtgacagagcgagactccgtctcaaaaaaaaaaaaaaaagacagcttccatgtaaagaactattcaggtcaaaatagctagctatttttttttaaatctggttgtttgctttatgagtagtcttaattaa

SEQ ID NO: 79 - DNA, 3877 bp, Homo sapiens
tgcagacatacctccttctatatagcacatcactttattgatcgaccataagattcatggtcgatcaataaagcaatggttcatgaagtttgatgaaagaagtttaataaaagaagccattgccatagcatagaagtgcaaggtgaggcagcaagtgctgatatagaagctgtggcaagttatccagaagatctagtgaagatattgatgaaagtggctacactaacaacatattttaagtgtagatgaaatagccttctattgtaagaagatgctgtctagtactttcatagctagagaggagaagtcagtgacgggcatcaaaggataggctgaccctcttgttaggggctaatgcagctggtgactttaaattgaaaccagtgctctttcaccattctgaaaaatctgagggcccttaacaattatgctaaatctactctgcctgtgctctataaatggaacagcaaagtctggatgacagtacatctgttgacagcatggtttactgactattttaagcctactgttgagacctacagctgagaaaaagaagattccttgattcaaaatattactgcccattgacaatgcaccaggtcacccaagagcttagatggagatggacaaggagattaatgttttcatgcctgctgacacaacatgaatactgcagcccatggatcaagggataattttgactttcaagtctgattatttaaaagaatacatttcatgaaatggtggctgccataaatagtgattacgctgatggttctaggtgtagtacattaaaaaccttctggaaaggattccccattctaaatgccactaagaatattgatgtttcatgggaggaggtcaaaatatcaatattagtaggagtgtggaagaaattgattccaattctcatggatgactttgaggggttcaaaacttcagtgaaggatgtccctgcagatgttgtggaaatagcaagagcactagaattagaagtggagcctgaagatgtgagaattgctgcaatctcttgataaaacttgagcagagaagagttactttttatgaatgagcaaagaaagtggtttcttgagatggactctatcttggtgaagatgctgtgaacattgttgacaaccaaggatttagaataatccataaacttgttgacaaagcagtggaaaggtttgagaggattgactccaaatttgaaagaagttatactgtgggtgaaatactatgaaatgctatcaaatagcatcacatgctatagagaaatatttcatgaaaggaagtatcaattgatctggcaaacttaattgctgtcttattttaagaaattgccacagctgccccagtcttcagcaactgccaccctgatccatgagctgctatcaatatcaaagcaagacccttcaccagccaaaaaattaagagtccttgaaggctcagatgatcatatgcatttttttagcaataaaatattttcaaattaaggtctgtacattttttagacataatgctattacacacttaattgactgtagtgtaaacataacttttataggcacaggggaaccgaaaaatttgtgtgattggctttactgcaatatttgctttattgcacagtctggaaccaaatccacagtatctcctaggtatgcctatatagcaaatttcttaagaatagaggacaaatcacttgcttctgattgaggttaaaatatgcccatgaccttcatttctttgccttccctccctccctgcactcctcccaaatgacttgtgaatattattttttcattctttttcattccagcagagctggtttggaattcatgatgttgaaagaatagccagtaggaacatgtggtggggtgatgttttgttggcatttaccattacagaaaatcacaagaaaattggagccattagcagcagggaaaggaaaatgagttctttatctgctgagggcatctggtgagggagggtctgtgaagatgccgcgggtgcactgctctagtatgaaatgccatttgaaggaggctcagagcacattagcgccgtcatccctgtctgatgttctcaccacacgcaagttcgtgaataattaaattgttaggaaggggaaagtcatgcatggcgggtcttgcccgaggctcaggcagacacacaatgaggtcgctactctgggagcccagtggtccaggatgccagtctggcagtgccagggaaggatgcttcctttcaataagcgaacattgtgagggagcggggtggaggcaagagaccgcttagaaatcagcacatgtgaattctgcttcaaactctgccactaaccagctatttgaccttccagaagttgcttcttcatctataatgaaggatgatgccaagaggattttaactttttgagaaataaagctcctttgagactgtaatgaaagctgtggattctttccacagaaaatggtgcatatgtctgtcgatgacatttcacatacaactttaggaagtttagaaatctttggggactcaaggatcccagcttaagaagaagtcttgcatgagatgatgtctgaactttttttgtatctctacaattgcatttttctgagactttggatcttggaaggaacctagaatgtcagctgggctctcacttctactctcaacaagaggcaagcctgccctgccagcatttcgtgcagaaggcgcaagcaacatgggagcctcctgtgttttcctcaaaagacaccatacttctttttcattagagacagggtctcagcctcgctctgttgcctagagtgcagtggcgccatgatcctcccccctcagtctcttgagctgctgggactacaggcacatgccaccatccccggctaattatatatatatatatatatatatataaatgtgtgtgtgtgtgtgtgtgtgtgtgtgtgtgtatctgtctatttatctatctatctatctatctatctatctatctatctatctatctatctatctatcgagtagagatggggccttgctattttgtccaggctagtcttgaactcttggcctcaagcgatcctcctgccttgggctcccaaagtgctgagattacaggcatgagacactgcatctggccctctataacctcttgatgtgtgcattctaagcgggaagaaacagacagcaaatgcacagtatgtatagcatgatgtcagtgatcagggctttgaaaatattgatgaagcacagtgatgccatagacagtgatggggtgaggtgctgttgtcgagttgggatggtcagataacggctctgtggaggggatatgtgggaaaagatgtgaataaaagagggattgggaccgggcgctgtggctcacacctgtcatcccagcattttgggaggccaaggtggatggatcagttgaggccaagagttcaagacaagcctgcccaacatggagaaaccccatctctactgaaaaatacaaaaattagccaagtgtggtgacacatgcctgtaatcccagctacttgggaggctgaggcatgagaattgcttgagcctgggaggcagaggttgcagtgagctgaggtggcaccactgcactccagcctaggcgacagatcaagactgtctccaaaacaaaaaagagggactgagccatgcaaatctaaagtaagaacattctaggcagaagatgtggcacagttaaggagcagtggaaagtgccaatgttcctggagctgaatgaggggagggggaagggaggagggagaggtgggagacaggttgagagactggcagagctgaggttggggtagttctttgtctactggaaacacaattatctgtactcaaatgacatctaata

SEQ ID NO: 80 - DNA, 172827 bp, Homo sapiens
accttcatacttcttccacacgcataccaaagaaaataagaatctcaaggttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggtcggtctttctccaccagactccacctggaactttcttccttttcgtcctgtgctggcctaacccctgctcggcctcggccctcagctgccggctctaacaaagcctctgtctttcccagacccctgtgaccaggtcaggctctgctccctgcgttcctctctccttgcttccctcctcctcccctccccagaatcgcttgaacctgggaggcagacgttgcagtgagctgagatcgcaccattgcactccagcctgggtgacaagagcgagactccatctcaaaacaaaaaacaaaaaacacaactcttgctggctccttgattttagcccagtgagattcacttctaatttctttttttctttgagacagtctgttctgtcacccaggctggagtgcagtggcgtaatcatggctcactgcagcctcaaccttcctggactcaagtgaaccttccacctcagcctcccaggtagccgggactacaggggtgcaccagcatgcctggctaatttttgcattttttgtagagatggggtttcactatgttgcccaggctggtctgaaactcctgtgccccagcagtcctcctgccttggtctcccaaagttctgagattacaggcatgagccactgcgcctgggcttccatttctgatttccaaaactctaggataataaatttacattgttttaagccaccaaattgtagtaatctgttacagcagcaataagaaatgaatacagccatgcttgataattcctttatcaaaagctacctattggtgttaggaagtattgttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgcc

SEQ ID NO: 81 - DNA, 168020 bp, Homo sapiens
atctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgcc

SEQ ID NO: 82 - DNA, 170129 bp, Homo sapiens
ttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgcc

SEQ ID NO: 83 - DNA, 184264 bp, Homo sapiens
atctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaatttacttttctctataccaaatcacccatggaatagttattgaacacctgctttgtgaggctcaaagaataaagaggaggtaggatttttcactgattctataagcccagcattacctgataccaaaaccaggcaaagaaaacagaagaagaggaaggaaaactacaggtccatatccctcattaacacagacacaaaaattctaaataaaattttaacaaattaaactaaacaatatatttaaagatgatatataactactcagtgtggtttgtcccacaaatgcagagttggtttaatatttaaatatcaaccagtgtaattcagcacattaataaagtaaaaaagaaaaccatatgatcatttcaacgatgcagaaaaaaagtttcataaagccaccatcattactgataaaacctgtcaacaaggaagatacatagatgaaaaataagcacaggaagagatacttaatgtcattaaacactaagaaaatgcaaactaaaaccacagcaagataccattaccatctattaaagtggctaaaattacaaagactgacaatagcaagtgttggtgaggatgtggagggaaggaattctcatacactgctcatgggactgtcaaataatatggtcactttggaaaacagttcagtagttcctttaaaagttcaacagtcactaaccatatgatccagcatggccttctaattatttttccaagagaaaaggaaatctgtgaatgttcatagcagctttatttgtaatagccaaaatttgaaaacaacacaaagctcaccaattgataacaaattatgatatatccatgcaaataaagtgctactcggaaataaaaaagaatattgttatacacacaaaatcattaaatctcacagaaattattacaagtagtgcttgctttggcagcacgtttagtaaaattggaatgatacagagattagcgtggcccctgcacaaggaggacatgcaaattcatgaagtgttccatattttaaatttaattttatgataaagaaaaacattggagggctgggcgtggtggctcacgcctgtaatcccagcactttgggaggccgaggtgggtggatcacaaggtcaggagactgagaccatcctggctaacatgatgaaaccccgtctctactaaaaatacaaaaaattagctgggcatggtggtggacacctgtagtcccagctactcgggaggctgaggcaggagaatggcgtgaacccagggggcggagcttgcagtgagccgagatggcgccactgcactccaacctgggcaacagagcgagactccgtctcaaaaaaaaaaaaaaaagaaaagaaaagaaaagaaaaacatgggaaggatctggcaagatgtctgaataggaacgctctggcctgccagcgagaccaatgcagaaggcaggggatttctgcatttccaactgaggtaccctgttcatctcattgggactggttaggcagtgggtgcagcccatggaaggcaggcagaagcagggcggggtgttgcctcaacccaggaagtgcaaggagtggggggcctccctccaccagccaagggaagctgtgagggactgtgctatctggcccagacactacgcgtttcccacggtttttgcaatccacagaacaggagagtccctcatgtgactacaccaccagggccctgggtttcaagcacaaaactgggtggctgtttgggcagacactgagccagctgcaggagtgtttttttataccctagtggcgcctggaaccacagcaagacagaactgttcaccccctggaaagggggctgaagctagggagccaagtgggctcactcagcgggtcccactcccacggagcccagcaagctaagagccactggcttgaaattcctgctgccagcacagtagtctggagctgacctggagcttggttgggggaggggcatctgtcattactggggcttgaataggtggttttcccctgacagtgctaaggaggcctggaagttcggactgggcggaactcaacacagcacggcaaagaggctgtggccagactgcctctctagattcctcctcactgggcagggcatctctgaaagaaaggcagcagtcccagtcaggggcttatagataaaagtcccaactcccttggacagagcacctgggggaaggggcggctgtgggtgcagcttcagtggacttaaacgttcctgcctgctggctctgcagagagcagcagatgctgacaaggagggctctcccagcacagcactcgagctctgctaagggacagactgcctcctcaagtgggtccctgacccctgtgtcacctgacggggagagacctcccaacaggggttgacagacacctcatacaggagagctctggttggcatcaggctggtgcccctctaagatgaagcttccagaggaaggagcaggcagcaatctttgctgttctgcagcctccactggttatacccaggcaaatagggtctggagtggacctccagcaaactgcagcagacctgcagaaaaggggtctgactgttagaagaaaaactaacaaacagaaagcagtaacatcaacatcaacaaaaggatccccacacaaaaaccccaaccacaggtcatcagcctcaaagatcaaaggtagataaatccacaaagatgaggaaaaaccagcttaaaaatgctggaaatttcaaaaatcagaatgcctcttccccaaatgatcataactcctgtctagtaagggcacaaaactggacagaaaatgagtttgaaagaattgccaaattgacagaagtaggcttcagcatatgggtaataacaaactcctctgaggtaagggagcatgttctagccaaatgcaaggaagctaagaacgttgacaaggttataggaatggctaactaggataaccagtttagaggagaacataaatgacctcatggagctgaaaaagacagcacgagaacttcgtgaagcatacacaagtatcaatagccgaatcgatcaagaggaagaaaggatgtgagagactgaagaacaacttactgaaatagggcatgaagacaagattagagaaaaagaatgaaaaggaacaaacaaagcctccaagaaatatgggagtatgtgaaaagaccaaacctatgattgatcagggtccctgaaagtgatggggagaatggaaccaagttggaaaacacacttcagaatattacccaggagaacttccccaacctagcaagacaggccaacattcaaattcaggaaatacagagaatgccacaaagatactcctcgagaagagcaaccccaagacacataatcgtcagattcaccaaggttgaaatgaaggaaaaaatgttaaggtcagccagagagaagggtcaggttacctacaaagggaagcccatcagatgaacagtggatctctctgcagaaaccctagaagccagaagagagtgagggccaatattcaacattcttaaaaaaattttcaacccagaattccatatccagccaaactaagcttcataaatgagggagaaatatagtcctttacagacaagcaaatgctgagggattttgtcaccaccaatcctgccctacaagagctcctgaaggaagcactaaatatggaaaggaacaactggtaccagccaccacaaaaacacaccagaatataaagaccaatgacactatgaaaaaactgcataaaggaatgtgcaaaataaccagcaagcgtcatgatgaccggatcaaatttacacataacaatattaaccttaaatgtaaatgggctaactgccccaattaaaagacacagactggcaaattggataaagagtcaagacccatcggtgtgctgcattcaggagacccatctcatatgcaaagacacacatcggctcaaaataaagggatggaggaatatttaccaagcaaatggaaagcaaaaagagcaggggctgcaatcctagtctctgataaaacagactttaaagcaacaaagacaaaggagggcattaaataatggtaaagggatcaatgcaataagaagagctaactatcctaaatatatatgcacctaatacaggagcactcagattcataaaagaagttcttagagacatacaaagagacttaggctcccacgcaataatagtgggagagtttaacaccccactgtcaatattagatcaacgagacagaaaattaataaggatattcaggacttgaactcagctctggaccaaacagacctaacagacatctacagaactctccaccccaaatcagcagaatatacattcttctaagaaccacatagcacttattctaaaatcggtcacataattggaagtaaaacactcctcagcaaatgcaaaagaacggaaatcataacagtctctcagaccacagtgcagtcaaattagaacccaggattaagaaactcactcaaaaccacacaattacatggaaactgaacaagctgctcctgaatgactactggatgaatgacaaaattaaggcagaaataaaaaagttatttgaaaccaatgagaacaaagacgcaacataccaaaatctctgggacacagctaaagcagtattaagagaaaaatttatagcactaaatgcctacagcagaaagtggaaaagatgtaaaattgacactctaacatcacaattaaaagaactagagaagcaagagcaaacaaattgaaaagctagcagaagacaagaaataattaatatcagagcagaagtgaaggagatagagacacaaaaaacccttcaaaaaaatcaatgaatccaggagttggttttgtgaaaagattaacaaaatagaccactagctagactaatatagaggaaaagagagaagaatcaaatagacacaataaaaaatgataaaggggatatcaccactgatcccacagaaatacaaactaccatccgagaatactataaacacctctatgcaaataaactagaaaatctagaagaaatggataaatttctggacacatacaccctcccaacactaaaccaggaagaaatcgaatccctcaatagaccagtaacaagttctgaaattcaggcagtaattaatagcctactaacaacaacaaaaagcccaggaccagacagattcacagaccaattctaccagaggtacaaagaggagctggtactattccttctgaaactattccaaacaatagaaaaagagggactcctccctaactcattttatgaggccagcatcatcctgattccaaaacctggcaaagacacaataaaaaaggaaaatttcaggtcaatatgcctaatgaacatctatgcgaaaatcctcaacaaaaatgggcaaatagaatccagcagcacatcaaaaagcttatccaccatgatcaggtgggcttcatctctggaatgaaagcctggttcaacatatgcaaatcaataaacataatcaatacataaagagaacaaatgacaaaaactacatgattagctcaacagatgcagaaaaggccttcaataaaattcaacgccccttcatgctaaaaattcttaataaactaggtatcgatggaaggtatcccaaaataataacagctatttatgacaaacccacagccagaatcatactgaatgggcaaaaactggaagcattccctttgaaaactggcacaagacaaggatgccctctctcaccactcctattcaacacagtaatggaagttctggcctgggcaatcaggcaagagaaagaaataaagggtattcagataggaaggcaggaaatcaaattgtctctgtttgcagatgacattattgtatatttagaaaaccccatcgtctcagcccaaaatctccttaagctgataagcaacttcagcgaaatctcaggatacaaaatcaatatgcaaaaatcaccagcattccaaatcaataaatgtaatccatcacataaacagaacctataacaaatccacatgattatctgaatagatgcagaaaaggcctttgacaaaattcaacacccttcatgctaaaaactctcaataaacttggtatcaatggaatgtatctcaaaacagtaacagctatttatgacaaacccacagccaatatcatactgaatgggcaaaaactgaaagcattccctttgaaaaccagcacaagacaaggatgccctctcttaccactcctattcaacatagtattggaagttctggtcagggcaatcaggcaagagaaagaaataaaaggtattcaaataggaaaagaggaagtcaaatagtctctatttgcagatgacatgactgtatatttagaaaaccccatcatctcagccccaaatctccttaagctgataagcaagttcagcaaactttcaggatacagaatcaatgtgcaaaaatcacaagcattcctgtacacaaataacagacaaacagagagccaaatcatgagtgaactcccattcacaattgctacaaagagaataaaatacctaggaatccaacttacaagggatgtgaaggacctcttcaaggacaactacaaaccattgctcaaggaaataagagaggacacaaatggaaaagcaatccatgctcatggataggaacaatattgtgaaaatggccatactgctcaaagtaatttatagattcaatgctatccccatcaagctaccactgactttctttacagaattggaaagaactactttaactccatatggaaccaaaaaagagcccgcatagccaagacaatcctgggcaagaagaacaaagctggaggcatcatgctacctgacttcaaacaatactacaaggctagctacagtaacaaaaacagcatggtaccggtaccaaaacagatacttaggccaatggaacagaacagagaggcctcagaaataacatcacacatctacaaccaactgatctttgacaaacctgacacaaacaagcaatggggaaaatattccctgtttaataaatggtgctgggaaaactggctagccatatgcagaagcctgaaactggaccccttcctcacaccttatacaaaaattaactcaagatggatcaaagacttaaacgtaagacctaggtccataaaaatcctagaagaaaacctgggcaataccattcaggatgtaggcatgggcaaagactttatctctaaagcaccaaaagcaatggcaacaaaaaccgaaattagaatttctctgatgactagtgatgatgagcattttttcgtgtgtccgttggctgcataaatgtcttcttttgagaagtgtctgttcatatcctttgcccactttttgatggggttgtttgttttcttcttgtaaatttgtttaagttctttgtagattctggatatcagccctttgtcagatggatagattgcaaaaattttttcccattctgtaggttgcctgatcactctgatggtagtttctcttgctgtgcagaagctctttagtttaattagatcccatatgtcaattttggcttttgttgcccttgcttttggtgttttagtcatcaagtctttgcccatgcctatgtcctgaatgatattgcctaggttttcttctagggattttatggttttaggtctaaaatttaagtctttaatccatcatgaactaatttttgtataaggtgtaaggaagggatccagtttcaactttctacatatggctagccagttttcccaacaccatttattaaatagggaatccttttcccactgcttgtttgtgtcaggtctgtcaaagatcagatggttgtagatgtgaggtgttatttctgaggcctctgttccattccattggtctatatatctgttttggtaccagtaccatactgtagccttgtagtatagtttgaagtcaggtagagtgatgcctccagctttgttcattttgcttaggattgtcttggctatgcaggctctttctttggttccatatgaactttaaagtagttttttccaattctgtgaagaaagtcattggataccatctcaggctggttagaatggtgatcattaaaaatcaggcaacaacagatgctaaagaggatgtggagaaataggaatgcttttacactgttggtgggagtgtaaatttgttcaaccattgtggaacacagtgtggtgattcctcaaggatctagaactagaaataccatttgactcagcgatcccattactgggtatatacccaaagaattataaatcatgctagtataaagacacatgcacatgtatgtttattgtggcactattcacaatagcaaagacttggaacccacccaaatgtccatcaatgacaggctggattaagaaaatgtggcacatatacaccatggaatactatgcagccataaaaaaggatgagttcatgtcctttgcagggacatggatgaagctggaaaccaccattctcagcaaactatcacaaggatggaaaatcaaacaccacatattctcactcataggtgggaactgaacaatgagaacacttggacacagggtggggaacatcacacactggggcctgtcaggggttagggagctgggggagggatagcattaggagaaatacctaatgtaaatgatgagttgttgggtgcagcaaaccaccatggcacatgtatacatatgtaacaaacctgcacattgtgcacatgtaccgtagaacttaaaatataatttaaaaaacaaaaaaacaaaattgacaaatgggatctaattaaactaaagagcttctgcatagcaaaagaaactatcatcagagttaacaggcaacctacagaatgggagaaaaattttgcaatctatccatctgacaaagggcaaatatccagaatctacaaagaacttaaacaaatttacaagaaaaaacaaacaaccccatcaaaaagtgggcaaagtatatgaacagaaacttctgaaaagaagactttaatgcagccaacagacatatgaaaaaattctcatcatcgctggtcatttagagaaatgcaaatcaaaaacaacaatgagatactatctcaggccagttagaatggcaatcattaaaaagtcaggaaacaacagacgctggataggatgtggagaaatagaaacatttttacattgttggtgggagtataaattagttcaaccattgtggaagacagtgtggtgattcctcaaggatctagagctagaaataccatttgacccagcaatcccattactgggtatatacccaaagaattataaatcattctactataaagacacatgcacatgtatgtttattgcagcacaattcacaatagcaaagacatggaaccaacccaaatatccatcaataatagactggataaagaaaatgtgccacgtatacaccatggaatactatgcagccataaaaaaaggatgagttcatgtcctttgcagggaccggatgaagctggaaaccaccattctcagcacactatcagaagaacagaaaaccaaacactgcattttctcactcgtaagtgggagttgaacaatgagaacacaaggacatagggaggggagcatcacataccagggcctgtcaggaggtggggggctaggggagggatgacattaggagtgatacttaatgaaggtgatgggttgataggtgcagcaaaccaccatggcatgtgtatacctatgtaacaaaactgcgcattctgcccatgtagcccagaacttaaagtataataataaaaaaaaatcaccagcattcctatacacaaaaaataaacaagcagaaaaccaaatcatgagtgaactctcattcacaattgctacaaagaaaataaaatacctaggaatacaacttacaagggacatgaaggaactcttcaaggagaactacaaaccactgctcaaggaaataagaaaggacaaaaacaaatggaaaaaacattccatgctcatggataggaagaatcaatatcatgaaatggccatactgcccaaagttatttatagattcaatgctactcccatcaagctaccattaactttcctcatagaactagaaaaaactactttaaatttcatatggaacctaaaaagagcccgtatggccaaggcaatcctaagcaaaaagaacaaagttggaagcatcatgctacccgactacaaggctacagtaacaaaaacagcatggtactggtaccaaaacagatatatagaccaatggaacagaacagatgccccagaaaaacaccacacatctacaaccatctgatctttgacgaccctgagaaaaacaagcaatagggaaaggattccctatttaataaatggttctgggaaaactggctagccatatgcagaaaacaaaaactggaccccttgcttacatcttttaactcaagatggattaaagacttaaaagtaaaacctaaaaccttaaaaatcctagaagaaaacctaggcaatatcattcaggacagaggcctgggcaaagactttatgactaaaacaccaaaggcaattacaacaaaagccagaattgacaaatgagatctaattaaactaaagaacttctgcacagcaaaagaaactatcatcagagtgaacaggcaacctacagaatgggagagaatttttgcaatctatccatctgacaaagagctaatatgcagaatctacaaggaacttaaacaaatttacaagaaaaaaaaaaaaacaaccccatcaaaaagtgggcaaaaagaagacatttatgcagccaacacacatatgaaaaaaagcccaacatcactggtcattagagaaatgcaaatcaacaccacaatgagataccatctcatgccagttagaatggcaatcattaaaaagtcaggaaacaacagatgctaaagaggatgtggagaaataggaacgcttttacactgttggttggagtgtaaattagttcaaccattgtggaagacagtgtggtgattcctcaagggtctagaaccagaaataccatttgacccagccatcccattactgggtatacacccaaaggattataaatcattctactataaagacacatgcacatgtatgtttactgcagcactatttacaataacaaagacttggaaccaacccaaatgcccatgaatgatagactgaataaagaaaatgtggcacatatacaccacggaatactatgcagccataaaaaggaatgaactcatgtcctttgcggggacatggatgaagctggaaaccatcatcctcagcaaactaacacaggaaccaaacactgcacattctcactcataagtgggagttgaacaatgagaacacatggacagaggaaggggaacgtcacacaccagggcctttcagggggtggagggggaaaggggagggagagcattagggcaaatatctaatgcatacggggcttaaaacctagatgatgggttgataggtgcagcaaaccaccatggcacatgtacacctacgtaaggaacctgcatgttcagcacatgtatcccagaacttaaagtaaaattgtttttaaaaaagtttttttaaattattccaagtaaaaagagacagactccctcccaagatattgtctgactcaatttacgttaaaactctagaaaatacaaactagtttatagtgacatagggcaaatcagtacttgcttgaaggggagattagtgtaggagggattacaaagggcaaaaggatgatgtggggcatgatggatatgtttactattttgttagtggatggttcatggacatcagttaaatactttatatgtatacagcttattttatctcagttattctcctgttttaaaaataaattattaaacactaataacaactgaagggagatctggttgatcatagtgattggtattagctaaacactgtcctttcagtgctatgattatatctttgttttaatagacttcattttttagagtagtttaagattcacagaaaaactgagcagaaagtacagagttctcatatactccttgcccccacatgtatacctccctcaccatcaacatcctgtaccacaatggtacatttgtcacaattagcgagcctatatgtatacattattatcactcaaagtccactgtttccattatactcttggtgctgtacattgtatggattttgacaaatgcataatgatgtgtatttgccattatcgtattatatagagtactttcattgccccaaaaatattctgtgctctgcctattcatctgtccctcaccatgaatctctggcaacctctgatctttctactgtcaccaaagttttgctttttccagaatatcatagtgttggaatcatagaatatgtagccttttcagattggcttctttcacttggtaatatgaacattcactttttaaccatagtactgtatttgatatacagctacatatgtaattattttatttcaagtctatgtttgtgagcccctggttagctgagtgtagacattctcaagagggggaaagggatgtggcc

SEQ ID NO: 84 - DNA, 176462 bp, Homo sapiens
accttcatacttcttccacacgcataccaaagaaaataagaatctcaaggttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggtcggtctttctccaccagactccacctggaactttcttccttttcgtcctgtgctggcctaacccctgctcggcctcggccctcagctgccggctctaacaaagcctctgtctttcccagacccctgtgaccaggtcaggctctgctccctgcgttcctctctccttgcttccctcctcctcccctccccagaatcgcttgaacctgggaggcagacgttgcagtgagctgagatcgcaccattgcactccagcctgggtgacaagagcgagactccatctcaaaacaaaaaacaaaaaacacaactcttgctggctccttgattttagcccagtgagattcacttctaatttctttttttctttgagacagtctgttctgtcacccaggctggagtgcagtggcgtaatcatggctcactgcagcctcaaccttcctggactcaagtgaaccttccacctcagcctcccaggtagccgggactacaggggtgcaccagcatgcctggctaatttttgcattttttgtagagatggggtttcactatgttgcccaggctggtctgaaactcctgtgccccagcagtcctcctgccttggtctcccaaagttctgagattacaggcatgagccactgcgcctgggcttccatttctgatttccaaaactctaggataataaatttacattgttttaagccaccaaattgtagtaatctgttacagcagcaataagaaatgaatacagccatgcttgataattcctttatcaaaagctacctattggtgttaggaagtattgttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaat

SEQ ID NO: 85 - DNA, 171655 bp, Homo sapiens
atctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctcagccagtgtcaactgagccgatcatttatgtgacagtttcattaccaaatggatgttctcaccactatttcaagtgcagtatgaaactttatttgaaattctaaaaaactaattaattaattaaggttgtttggctcttgcagcctgtattaatttcctagggcagccgtaacaaaggagtcacataccacatgacattttggtcagcagcaggctgcgtttctgacagtactccatacaattataacaccattatttttacggtaccttttctatggttagatacacaaatacttaccgtgttacagttgcctacagtattcagagtacagtcacatgctgtactggtttgcagccccggcgcattaggccatgccgtgcagcctagctgtgtagtaggctctcctggctaggtttgtgagtgtgccctctatgatgttcacacaacggcctaacgatgcatttctcacaacgtatccacgttaagtgacccatgactattcattctacaaactgagaagcttaagtaacagaaatttattttctcacagacttggaagacagaagcctgaaatcaagttgttagtagggccattgccctctgaaggctctagaggcaaatcttttcttgcctctttcagcttccggtggctcccagcaatccctgacattcttttccttgtagtaacacaactctaatccctacctcagtcttcacacagtgttctcccctgtgggtctctcaatctctcactcctcataaggacaagtctttgcattcagggcccctcaaatccagtgtgacctcatcttaatttgattacctttgtaaagatgcaatttccaaataaggtcacatttgtatgtactgcgggttaggacttgaacatatatttttagggggcacaagtgaacccacatcagaggtcaagccacaaagcagcctacatggcgaaaccagtcttgtcgtgaaaatgtaaactgaggtaagggccatgctgccttggaaagcgttctgtgttgtcattccagagccacgggggctggatagtgacaacagaggtgggttgcagatctatgggctactctttgcagaggcagtaagtagggactgccacagcattcaattaatttcctgtaagaatacattttattcaagttgataaaaaagctatacttattaatattgcataacattcctgtgctatcaaatgagaatctccagaaatgaatttgaatagctataaaacccacatttttctgcagatacatgtgtagccacctgagagccaggtccctcagtgtccacagacatagccctgccacctaccgcctgcttcccagagcaatgaagcttctgctaactcaggcttatcccagtctctatttcaggccatcagctggatgaagaattaatttagtaagcatgaaacagcttgcaaagcattggtgagtggctgagggccatgaaacgagaccaccgtgtggcccatctctgaagatgaatccaacagcagtgactctacctgcgtcctccccatcttttctgctttttcatacaatggcttattcactgcgtgtgacatcatcactagcactgtgtttatctatcacatttcttctgttttgtgggtttgttttgcattaaaggtctacttctctgagctttgagctgtaaggcttgactgtgagcagcaactgaagagtgtggcacctcacactcggtaggaagaagctgaatgacagatgtcggcagtgagggtggggaaagcagccaggtaccaagcagctgttttttaggctaaccattgaagggaagctcctaatccctgagttaacttttagcagagattaactcagtctatctattgggatgtaaaggatttgggcataaaggtatgttaattcggaggctctggaatgtataacaatttctcccattgaaatttatgataattaagtgttcaacttactggaattttccccacaagactcttctgggatgaatttgccttggggagaagactacgtaactgaaaaccagcatccaggccctcaagaagaaatataatctccaacagtctccttttcaatttctgtcaaatgtctggcttctcttgaagggatgttcacgagaagggacagccgccctcctccgagcctcctgtttcagctgatgcaccttcaagtacaaggtcctgttcttgggctctgttaaagtttccctcaagaaaaaaaccttacatttgccaatgcacttgatgtaaagttgttgaggatgttgactctcctttaaacatttattgaagctaggaataaacttaactggacctgtgtataggaaatcttaaatttctactaagagatgaaaaaaagaattcccttcccttccttaacaattcagctcccgttacacaaaaccaaacaagatgggattctgttgtggggggacagaacttcattgtcctgaagctaggtgttggagcccaagcagggtgaggagggagtcaaggaggcccatgtggtggtggagcatggcctggcatgggtctcagtgcccaagcaaggtgaagaggggaccatgcagggagtgagggtgtcactgcccaagtgaggtgagtagggcaattttgaaaagtcatgaaagttgaggaagggctgaggcaccattctagattgaaggagactaaaaagatgcaacactcacaatgcacaattctaaactgaaatctttgctctaaaggacattaggacaatgaaagaaacttgcacggggtctgagcattaggtagtagtaatgaattgatgttgagtccctaattttcatggttgtatgctgatgatgtaggaggttcttgtaggaaatacacactcaaaagtattctgaggtgatggggcatcatatcagaagcttattctcaaatggttcaggaaggaaaaagttttatactatacttctttggcaagtttagattgtttcaaaataaaatttttttaaaaagagcatttgttaaccatcagtttggtaaaaggtgaaaaatgttgataatacctagtgtttgtgaaggtgtggagaaacaaagtttcatacactattgtcaaaagtataaattgttacaatatttttggagagcaattttccagtatgtagcaaaaatttaaaagcaaatcttaactcagcaattctgcctttagaaatgtatttgtaggataacatacaggagagaaaaatgtattttactgcaacactgttgatactaacaaaaactggaaaccaccaaaacatttatcatgagggggttaagtaaagtatggtataactatacaatgagtgtactaggaaacccttagaaagaatgcagaaagatgtatgtggacttttacagaaaggtgagctactgtctaaatgcaaatgtgccaatatcatgtatatacagtcaggttccttttgttaaaaaccaaaagcgtatgtttagaagcaaaagcactcatataaaggcctggtatagagcagtggctaaaaacagtgccaagatactgcctcaacttcctctcacatgctgccctggtgatactgaggctggttcaggaaccatgacagcctgtttgtatgaattccttaaagcacaaattacttagtttctttcataacagtcacctaatcccttagtttaaaatggttgtgttcatggaatactatgcagccataaaaaaggagatcacatcctttgcagcaacatgagtggagctggaggccattatcctaagagaactaatgctgcaacggaaaaaccaaataccgcatgttttcacttacaagtgggagctaaacaatgagaacacatggatacaaagaggggaaaaacagacactgaggcctacttgagggtgaagggcaggaggaggaagagtatcagaaaaaattcctattgggtactatgcttattacctgggtgatgaaacaatttgaacaccaaatccctgtgacacagtttacctacataacaaacctgcacatgtactcctgaacctaaaagttacaataaataaaaaataaaatggttgtgtcctgacaggaaataagtgttccagatctgcttgcctcctacccccttaagaactcccagcgccaaggacagcttcacagtgatgtgctgaatttgttttttctctgccccacccaccattttgcttctggtaagattttgaatccctggttaattaatgaagaactaaccttacaatgggtatatgcttgtggtccctttccaccagcccccagcccacctaacatactagttgtgggactgcctaaagaaagaatgtcaggaaggccagagaggcgagctgaggatccccaggtggaggcctccacagtaagtgccacaaggccattgcatcatgagggcgtgttccatgaagatgttctagccatggtgtttgtccactgtcccatgtgcctgactgcttgggcacagtggacagtggtcttagccaaggcctagttatgttcaggggcagatccctggcttctcctaaatgcactggccgtgaaaaggggcagtcagcttcagagggagttgaggagctggggatggggaaggctttgaagatgcccctcaaagccccactggatgtcaatcagccagtttccagacaagataaactagataacttgcaggattctaggtgtgggtagagatgagaatcaaactgggaaacgtaactcttcccatagaagcagctaaaatggctgggcatggtggctcaggcctgtaatcccagcactttgggaggctgaggcaggtggatcataaggtcaggagttcgagacaagcctggccaacacagtgaaaccccatctctactaaaaatacaaaaatgagccgggcatgtggtgggcgcctgtaatcccagctactcaggaggctaaggcaggagaatcgcttgaaccctggaggtggaggttgcagtgagccaagatcccgccactgcactctatctagcctgggcgacagagcgagaatctgcctcaaaaaaaaaatagaagtagctaaaacaatttgtgtgtgtgtgtgtgtgtgtgtgtgtgtgtgttggggttggggaggaaggtgttaagatcacaggaataaataaaaatgttagcatagtattgctatcacagtatttctgttgttacatgcttgagtcaatctttgtttttagaggaaaaaagcgtccagaaaaagaaggacgctggaacctaggaactccatgatttgtgctgaggtttttttgttttttgttgcaatggtgtattctgaggacagggtctaagaaataacttcttagttattcaaatgacttctgaatgaaacattaaaaatactgaattgaaatgaccccaaaacgtcttaactattagcaaatagctaacctcttgtatcccagatattgttttgtggaaagaaaatgaacttgctggataagagaccaactgaaacaaaatggaaagcatggcagtgtgctatatccatatatatatacacacacacacacacatatatatatacatacatatatatacatacacatatatatatacatacacacatatatatatatatatatactttttactaaggctaggaacttgaggcgaggattttttctttcccagtttggattccctttagaattttgggttcagacaacaacttttacagttcttgaaccaagttcccttttactgaaagttaacaaaatacaaagaggggctgtgggctgtgggctgtgaaaggattctgtagaaaattgtaaggcccagattaagagcatgcagacagcagtctatcagtcagattctaacctgaaaatcagaaaccactcaagtgttcagatggaagaaatctaatgcagagaataggtgacacactcagagtcaacatcagagaaagcactgccacagatgctatcagacacagcttttaaactaaaaatgctactatgttcaaggaaaataaagctacatttgagaatctggcatactatgaaaaaggaagaaggtccagtgctgtggctcatgcctgtaatcctagagctttgggaagctggggtgggcagatcacttgaggtcaggagtttgagaccagcctggcaacacagcacaacccctctctactaaaaatacaaaaattagccaggcatggtggtgcacacctgtaatcccagttacatgggaggcgtaagaattgcttgaacctggaaggcagaggttgctgtgagcccagattttgccactgtactccaaccttgggcgacagagtgatactccgtctccagaaaaaaggaagcaaatgaaaagtctattactgagaaacagaaaaacttaaattgagcactcaatgggtatatttaagccagattacatagctaaagagaaacttagtgaactggaaggtaaattagatccagaatgaagcctgggtaaggagtaggggacaaaaggatggaaacgagcacttaagaggcacaggagatacagtgagaaggctttatttggagtcctagaaggaaatgaaaaaagaatggtatagagctaatatctgagcacacaatggctgagaatttaccaaaactcatgaaagataaatacacaaatttaaaagcccagagtatacaaaaaaggatcacttataaaaaatccacaccaaaataaaacacagtgaaactggaataaaccgaagattaaaaaaatcttaaaagaagctattttaaaaagaatacattaaactggcagatgaacagccagagtggaaatcacacttcagtggcttaatgcatccaatgtgacaaaagaacatgaggtctaacctagaattctattcccacaaaaaaccatttttaagaatgaagttatttttaggcaaataaaaattgtgaagttttacctctaacaggacagagtattctaaagaaagttttctagagagaaggaaaatgtccccaaataaaaaattgcagaggtggagaagaatgaaaggaaatgaaaaggttgggcatggtggctcatgcctgtaatcctagcaatttgggaggccaaggcaggtggatcacctgaggtcaggagttcaagaccagcctggccaacacagtgaaacccccgtctctactaaaaatacaacaattagccgggcatggtggtgtgtgcctatagtcccagctactggggaggctgaggtaggagaattgcttgaatctgggaggtagccattgcagtgagccgagattttgccactgcactccagcctgggtgacaaagcaagactgtctccaaaaaaaaaaaataaataaataaatttaaaaaaaaagaaaagtaattaaacgtttggtatagaaaataataacatattttaatatatatgtacatttatatgtatatataattaaaattaaccaaaacaacagcatataggatggaaggtaagaagtattctaggaactttgcattgtctaggacgaagataaaagtatcaattaacattaggctttggtaagtcaagaatccaccttttaattcctaggccactaaaagaagagaaaaagtatataacttccaaaccaaaagatggaaaaatagagtatgaatagaatcattcataactataaattaaagggctaaatgatcctgttaaagtaagttatcagactggattaaaacaaactatatgctatttccaagaggtacatctaaaacataaaaatacagaaagcgtgaaagtaaagaaagagaaatgccatataacggtaaccaaaaaagaagctgatgttattaataccagaaaaaaagagacttttagtaaaaggcattactagggataaaaggtttacttcataaaatttcaattcatataacaattttatatttgtgtggcctcaaatatataaagcaaagttcacagaactatatctaagtagagataactcaacaattgtctcattaatagaagcaaataaaacttcattaagagcagagaagatatgaacaacgtattacaatctaatggctttatgtagatgactgcatgcggcatctgcagaacatgcattcttttcaagtgcccacaaatcttcactaaggttaaacacatgctgggccataaagcaaatctcaacacaattcaaaggacagcagtcacatggaccatgttttgtaacaacaataacaaaaatataactaggaaattcccatgtttggaagttaaaaaatatacttctaaataagccatggaatctgttgtgatttcccaattttcattcctgactttgattatttgtgcttttctttctcaatcacatcagaggtttaccaattttgtcttttcaaagcagcaaccttgactttgttgttctttgttgtgtttgctgtttcatcaacttttgctctcattcttatctccttcaacttttaaaaagatagtcaatttaacaacgtttgtacaaaatttttataaagtacagagcatttttattaagccttaaaataatcttgtaaacaggtcttttccctcattttacagatgggaaaatgacagaacaggaaataaatccatattattgcactgaatggaatatggccccatggtttgcacccaagaccagaggaacttcacctgctcctctctggggctttgccctgcccaccccaggaccactacttatcctctgagatcttaagggacactcaccagaaatagccatggttaagatggtaaaagtctggctctcaccaacccttcctacagtaatctccagcacatctgaatattgctgggaaaacacaggggaaacaagatgtgtaccatgtgagtgagcaggctgcccaggccagaaaggcaagcgtgaggcagccctcaacccccaacgtgtggttactggcctcagctggaggctcctcctgctgagcccttttgcagcccgacaaagacaaaacatgtttgtttagagacaatggattgcttacttagaagcaagataccactcaggaacatccaaaaaataacttttctcatgtttcttctcaagttttgtctgagtagggggtggtccttgagggatttccttgacttccaggtaagagttgtcctccactgcccaagcatctagatgctgagtctttggacagggccaccacacttcagacttattccatacattcttatgcaaatacttctcattctaggcagccttctaaggaccttaacactattaatgtttccaaccctcattacaacctgaggttgctactattatctttacaaaagacaggtgagggcccagtatggtagcctgtggtggttcaggcctgtaatctcagcaccttgggagtctgaggctgggcagattacttgaggtcaggagttcaagaccagcccagccaacaatgatgaaaccctttctctaccaaaaataccaaagttagcctggcatggtggcgcatgcctgtaatcccagctactctggaggctgaggcatgagaattgcttgagctcaggaggtggagactgcagtgagctaatgcccctgcactccagcctgggcgacagaacgagaccgtcttaaaaaaaaaaaaaaaaaaaaaaaaaaaaaaaaaaaagacacgtgaggacacacaagtttagttacttgcctaaagtcatctggaaataagtgaaagtccttatttgaactcaggcttccttgtggagaccatgtcctcggccactatacttcactgactctacacaggtttcatgcaaacggcttccttcgcacaatgacactatccagacctgagaaccgccaggtctaaatgagaatggctcctcagtaggaagacaattgaagtactgtattctgcttccttctccatgtctctaggcctttagctgaagctggagaagagaaatgaagggtctccccagcccaggaactccttgggtacagctgtggccaattactcaaggtcttgatgcagacagacttcaggtccccaatgtctgccttcagctaacaccatcttcaggtgttgtcctggtggtgatcctctcatttctgaatcccacggaggaaaattcccctgcattgcaggattggtgttcagtaccgtttcacgcccagtgtcttcatacacaaaacatgaaattattttccaggctttcaccttcagacaaatttgctaatagagacatgcactcctatggaaggctattccatactcactgttttttcaggcttttcttttctctttctcctccccgcttttccctccccctttatttttcccacttgcatatcgttctctggaaggaaccgggggtggtgcctaaaccatgttccatccctggtctgagcaggctcagccgcaccagttcattgggtctgtgctacaagggagaccccaccatgtctgggatcagcctgaatggcttgtatctggctgtaggtacacttgaggacctgggcccatttctggagcatgcgagtagatgggggccgcagtaggagcttgtctggtgcttagtggggctgaggcactcagaatccccacctgagctgtggccatcctctcctttgttatttagcctgcatctccccaaaagtagacagtgcattaggttcagctggagctcaagtacgggagctctcctgtgtgaggagcacatggaaacctcaggttaaaaacaaccaaagctggtctcatcttcagcaaaaagaagcccaatccatgtccccacgactacggggaacgagtactccatggcaccctccttcctgcccacacatcagccctgccagagaccagccttgctggaggatgcctgggcacttccgtagctgcctttactcaggtcatcctagttcctactcctctcagaaaacccaattcaacgtcctgcccagatgtcaccaattcctccctcttggttggtcctagtcgctgtcctctgagcacctgcagtcttaattcatccattagggtggttgtgctcacagcctttctccctttattcatcctcatctaccagaatctactcctgctgccatcctctcccacccagtacctgggacagggacagtgcctagtagatcctcaagtatttgctgaataaatcagtccaagtctgtgtatagggtcaggcttgccagtgtcatgtgcaaaggaggatagagagcaagtatgatcagaacagtccaagtggagcagtggtagaaatgctccatctccctttcctccctcaactccacccttccccaccgcagccatcaaaacttactggtaggggtttggatacaaagtgaaacaaatatactcctagaaagagcatggaaactatctggctacagagataggagtcccagaaggagatgggaaactacatggctgagattgttctcttgtaaagacaatgggttttgaaaccagataccagacttcaaattcagcctttgctgattggcccactcacagtattctcagacaggttactcaattctcagaagagtctatttttaccctttgagttacctagttaacagcttcatacacagcagtagtttatgttcaattctacatgttcctgacagagctgtgtgtggtgactgatcactcacacaacctacctgctcccgagttaggatctggcccagtaacgacgatcacatggctccactgtggtcccctcaaaatctatcctgtgctcctcctagggaggcaccttctaacttctggtgaaaccagctgagctgctagccctgtgggatgagtctactaccctctctggtttggatctggtataacttacccaacaaagatctggcacacaaatggctcttgggtatcctccatctaaactcacagcccgttttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaagaacccgcgccggccctggggcacttccgcgccctctctgggacgctggaggactgactcgatggtccgggccgacggcgccggcgggagggagggaggggagcgcctcctcggctatttattgaggaccagctgcagggcgcgcgctccaggcgcggccaggaggccgtgggcggggctttctgtttccgtgcccattagcttctggggtaggctgggggaggggcacaggtaataaagtaaatacctgcctacctggttcctgaacacgtgattcattgccaggtgtgggtgcggggacgttcccggaagtgggggcctggcgggaaatgggggaatccgggaggggcgcaggacagcgctgggctggggacccattgccttctcagctggttgggggctggcccgagagcaccagcccttcctggtcgtcagcaccagaagcgcccccggttaggcactggggatgcggagtgggagcgcgcccctggagccgtccctgggaccgggccacgctcccacccggggcgccagcttggcagcgacctcgccccctgcccaccccaccgccggtgtcggcttccaaacccagggcctaaaatgactttgaagaccttttttttttttttaaattaatgtttgtgggtacatagtaggtgtccctatttgtcgagtacgtgagatatcttgatacagacaggaatgcaatgcgtaataatcatatcagggttaatggcgtgtccatcacttcaagcatttatcctttgtgttacaagcaatcaaattatattcttatttttaaatatacaactaagttattggctatagtcagccttttttaaaaacagcaacatctaaatatttttcatattaagtttaaataattgcaaagggtatatttttggcatgctgttaatattaagaacaaaattgctttcaagtgtatccaatggaatctaaatccctgaagatttggtattatccacttttaacagtcataagttttacatcttttagggtttttttccttgaacttttatgtccctcaccggctttttattctactgtaaaaatattttcattctatgtgcctcattgaattttatcctagtgtaaaatagttctatgcattgttttattgtttattgtttatcctagcatatatgtccgtaacgaaagtagattacattttttcttagtgttattttctggattattagcaaaattatataaatatttcaaaatgtttactgttaattcttagacaaaaagtgaagtgctttggaagcacaacttgtaatgagatggattttgttttacagctcaaattatttatattatttgaatgaattttacatattgctggggtgagccggtgtttggcatcagctcgacgcctatttttcatttttatacatgtgggtgctgagacactgtgttcactcaagtagagggaatgggcgtttcattgtagcaataagacccttgacggcatttgggcttcacgccacaaccccacccacctcgaagaacgtctgggcgagttagcaggcagcagcgactcctaaggaggagcagagccccaggcccaggtctgcagctttaggtgagagccccagagcgagcagaggattgggagttagagctgcccccaaaggatagtgagacacatgcagctgttgagcacttgaaatgtgggtagtgctgctgaggatctgaatttttaattacatttaatgtaaatagccacatgtggctaatggccaccttattggatagcacagctctagaaggagcttcaggtggtcctcacaggcctccagaattaaagctgcccttaaaggttcatggtaggcaaagactgggtttttacctctaggcagcaagatagaaaaatattcatatctgggttggaacacttcgctcaatgaaaggtggtgtgtgtgtggaagggattatgggaaacccacataaatcatcttgagtcagatgctttttattttatcttattatttatttgttttgagacaagctctcactttgttgcccaggctggagtcagggtggcatgattatggctccctgcagcctcgatctcccaggttcaagggatcctcccaccacagcctcccaagtagctgggactacaagtgcatgccacaacagccccactaatttttgtcttttttgtagagatggggcctcactatgttgcccaggctggccttgaactgctgggctcaagtgatccgtctgtcttggcctctgaaagtgttagaattcaggcgtgagccaccgtgcctgtcggatccttttgattttagatgacggcttttcctccttgagccttgttatattgcaggcacctttcatttggcctgtgtctacataacacacacagacaacagacacagacacagacacagacacatgcttgcctttctaacacttttagagatatctacacatcagagctgagttcagtagggcagtcattattcacatgtagcttatggtagtctgaattgagatgtgctgtaaatgtaaaatccacaccacatttctaagacttaggaaaagagaatgtaaactatcttattaataatttttaatgttgattacatgctgaaataatattttgactatattggggtagatcaaatacatggttgcaatgaattttacctgtttctttttactttaaatgcatctagaagatcagaagtcacatacatggctcacagtacatttccattgaacagcactgctctaggaggccaataggtgcagcagtgaggttgtctgggtttgctcttgctttgctggctcatctacctccctttggagtggtttaagtacaaattaatgttgagctaagcccatagggcttaattccaactctgtgtttagccattgaatttggtcacagatttatttttgttttttttagagacagcatcttgctctgtcacccaggatggagcgcagtggtgtgatcacatagctcactgcaacctcagtctcctgggctcaagcagtcctcctgcttcagcctcctgagtagctaggactataggtgtgaaccactagatccagattaaatatttttttttttttgtagatggagtctcactgtgtcctccaggctggagtacagtggcacgacctcgactcactgcaacctctgcttcccaggttcaagcgattctcctgtctcagcctcccacgtagctgggattataggcacatgccaccacaccaggctaatttttgtattttggtagagacaagatttcaccatgttggccaggctggtctcaaactcctgacctcaggtgatccgcccaccttggcctcccaaagtgctgggattacaggcgtgagccactgctcccggcctcagattaattttttaattttttttgcagcggtagggtcttgctgtgttgaccaggctggtctcaaattcctgggcctcaagtgatcctcccaccttggcttccaaaagtactgagattacaggtgtgaaccaccatgcccaatggcaaatttattttaaaataaaatctctcctcccactgtaccataatatcagttcattatgttaaatctggaaaacagaaaaattattcttaatttagtaaactagtttttggtcttgttgcccagactggaatgcagtggcacgatctcagttcactgcaacctccccctcccaggttcaagggattctcctgcctcagcctcctgagtagctgggattacaggcgcacaccaccatgcccagctaagtttttgtatttttagtagagatggggtttcatcatgttggccaggctggtctcaaactcctgaccttgggtgactcacctacctcggcctcccaaagtgctgggattacaggcgtgagccaccgcgcccggcctaaactttcctttttttaaaaaaaatagagacaaggtcttactatgttgcccaggctggtcttgaactactgagctcaaatgatccccctgcctcagcctcccaaagtgctgggattacaagcatgtgccaccacacccagcccataatttagtaaattttcttacttagtaaactttagtaaacttagtaaacttacttagtaaacttagtaaacttttttctatcaccagtttgtgagtgtttttcagatagtgtcataatcatactatatctgtatttttatatagcatttttacaaataatattatacattagcatttttcatgtttttactctctgtgatattccattaaactacagtctccttaactattctgtataactcacagaggttttttctaagtatgtcttttttaaaaaataaatcagtgctgttttagatagtagcgtgcagaacgctttcatcgtattttccttggaataattgacaagaagaggaatcactggttcaatagacagacatttttaagagtcttaaaataagaacaatagggaattagaaacactaataagcttaataggtaaacactggaaacaatcagagtaaagaactagacaaggttgttactcatcagtactattatttcccattgcagctggattaaacaaagaaaaaagaagtcagaatataaacattggaaagcagaggtgtaattgtcttatttgcagatatgatttcatttttggaaaactcacaagaattaacttgaaaaaactagaaaaaacgagaatgctgtaaggtgtgttttcaaaattaacatatagaaatcaagtttccttatatagaaactacagttggaataatggaaggaaagactacatttacaatagaaacaaacaaaagaccaaatgcccaggaattcatgactcacgtgcaagacccatatgaagaaaatttacagtgctcctggggacatagaggatgaactaaacttatggaaagattcttggatgttccattcacatgaatggaaacacttgacatcagaacagtcatttcttgtaaagtataattgtcatgatcctgataaaagctagcaatagaatctcctttggcaacccacaactgattctaaagttcacatggacaaatttaacagactcttgcttgtttctagctagaaaatgcctataaaaatatgaatgacgcaaggcactattaaggcacgttaataattaagctggtataattctgagacatacatataaagtctagaaatagacctaaacagtcatgggtattcggcatctggtaaagctagcatttcaaactagtggcaaagacagaacagggacagctgggaagcattggggaaaaaatgaagttggattcaaaccacagcccttacaccaggatgaatgccaggtgtatctaagactgaactgtgaaatgcacacacaccaaccatcctggcagctgctcccacttccataaaattttacaaagaaaaaaaaaaaactgcaggagattgctttgctcatattggactgagggagggtttttgttttctttctttcctttttactataacgcaaaatccaaaaactgtaaaagtaaagatagagcaattcaaacacatagaaataaaatacttccgtgtggcaaaaccactacaagaaaagtaaaaaaatcaaatgactaactgggaaaaaatatttgcatgttatatcacaaagggcaaatttccctgatacacagagcttctccaaaattgaaaacctgaacaacccagtggaaaaatgggctcacaggaaagcttatacaaatgattcaaaataaaaaagaatgcaagcccaaactacatggaaatacaatttttctcttattagaatggcaaagatcctgagtttgatccacgctgtggtggtgacagcatggtggggaaagcactcttccccgctggtggggtgttgacggacctcacctccagggaaggcagcgtgcggtgtggatggacgtgcacgtactctttgccgcagcaattctcctctacgagtctaccctgctggtatagtcacacactcatgaaatggtgtgtgaaaaggttattcacaatagtgtgtctaaagtaaaagatggagaaaacctaaaggtccaaactaaagacgtgattacataaattattgtacattcacgtgtattagttttccagggctgctgtaagaaagtaccccacacaatgtggcttaaataggaacaagttattgtctcacagttttggaggctagatgtctgagatcaaggtgtcagcaagtttggttccttctgaggctgtgagggagaatcggttccacgttttgtacctagctgctggtggtttgatggaaatccttggtgttcctttggacggagaccaccacttctcctgttgtccttcccagcttctccccaacctccccttttccctagtttataagacaggagaaaagggagaaagcacagagttggaaagaaacagaagatagcgagacgaccttggcgccaccacctggccctggtggttaaaataataataataataataataataataataataataataacccctgaccaaaactactggtgttatctgtaaactccagacattgtgtgagaaagcactgtaaaactttttgttctgttagctgatgtgtgtagcccccagtcacgttcctcacgcttacttgatctattatgaccctttcacgtgaaccccttagagttgtaagcccttaaaagggctaggaatttctttttcggggagctcggctcttaagacgtgagtctgccgatgctcccggccgaataaaaacctcttccttctttaatccggtgtctgaggagttttgtctgcgacttgtcctgctacacttggcttgtggacacagcacccagtctctgcctttaccatcacacacagccttctcactgcatgcatgcctgtgtgcaaatttctcccttttttaaggagaccagttatatcggattagggccctaaactactcactccagcatgacctcggcttaactaaatacatctgcaatgactctgtttccaaataaggtcacattaggaagtatctggggttaggacttcaacatacgaattttgggggaacacagttcaacccataacagcatgcaatgtactactttcagccataaaaaaggaagaggggcctctttataaaatggtatgggaaaatctccaagatgcatgtgaaataaagaaatcaatgtgccaagctatgttataatttgcataagaaagggtgaaatgaatgtgtacatatttgtgtatgttcataaaaatgttcctgaaagttcacaccagaaaccactaaccggggctgtcggtgaggaggcacctgggtggctggaagagaagggtgggaaggagaattttcagtgcatatcgtctttatactcctgcattttgaaccacgagaatatagtatttattcaaaaattatatgtaaacataaataatcctaaattgcatcagattgctaaactactacttcaagaaggagtatttcaatttataaagtttccaactataagtaaaagctctttactcactcacctccccaggattgggttgtggcaggtttgttttttctctaaatttgtaggcagcaaatagtgtctggttgtttaattttctttacccttctatcatgtgtgtcacccaattgagccatctctcccagggactgcctgtcctgtccttacatcaagtctttcggtaccttttgtagagtttgtgtccattgtgggaacacattctttattaaagaagttcaccttttgaattggccatcaattgctgttctctttcctgcttgccctttaacaccaacaatttcctttcatccctcaagctttacatggatgtgtaaaatctgtgtggcaggtggcgctgttgagctggaagggaccgtgggatgaatctggagaaacctgttaccagaggctcttaagggataacccacagtccctgggaaaaggtctagaaggagcaagcagcctcctactgttatcatttctgggtcctgtggaaagggagatgtctgtgtcaggagttctgactgacacttacatctaaaatgataatcaacaacagcgagaaattttatggggcttattttgtgccaagcactcttctaaatgctttatatatatagatacattgaatcttctcaacagccctttgatgaaggcactgtgtgtgtgtgtgtgtgtgtgtgtatatatatatatatatatatatatatatatatatatatatgcacatacatatacctgttctacagaaggggaaacagagagggaaagcaaattgtcccaggacacacagctggtagttttgaggctgtgatctttgacatctttgaaatgctctggcctgggcacctgctggttcaagcccagctgcttgttctcctcctgtagatatattcatctctggttgttgttcacaagccacagagtgccaagaccaaacaggaggctgttaggacaccacccttacaagcctctgccaacttggcaggaggaggaaatttttgttttaaaagaaagagaactggatgtcctcttgtacacatggattaactcacagtttcataagaccttgggaaaggagaaaatcaaaggagctgtctttccctaatttggacggagagttggtgaaaaatggcacctgctccaaggtattttcttgaatctgtgttgggctctgggtttcttatgggactgggcagttgtgtaatctttggtctctgctccctcatctggaatataggtaataataatacctacttcacagagttgtgaaaattaaattagcatatgtaaggcacttagaacatacatattgatatattgaatcttgtcaataacccattgatgacagcactgcatacatccccattttacagatgggggaacagagagggtaagaaaactgtcccaggactcacagctgggcagtcttgaggctcagatcttatgacgccatacagtatgcactatctgagttttcatgattggtgttgctgtggtcacactcccggaggtaccgtgtcttcctgaggggagtggatcacctttctctatctccctgggaagcggaagatgttggggcgggatctgaggacttgaaaagtgcagccttagctgggtcagtggttgacccctccctctctctgggtctggctgtgtcggagtccagagaaacactgagggagcaggtcaggagctggcagggagtgccccgtaggggccccacgggactgcccagggtctgtgggtgtggaaggtagcctgtggcaggttattctccgaacaatagctcttctgaagcatgatggtctggttgtgactggactaagggaaaattacaagaaaggcttacgttcatatctgcctgtgtggtgcgcaccagggtcccgagtacaaagcactgttactaaactggaggtgacagcagtgtagacacacacaatctggactggccctggaggacacatggaatacctcaaagacccagcaatgctagaaaagcgcaatggtgtagtcagcatagttagacgaggttgcagtaacaaatacaccctccctcccggtggcctaagacaagaaggtttatttgttcttcacgtaaacttcattgtaagtcagtttgctctcttctgtcttgcagccataatatctggaatgtgtggccttcagaattgccactgtagagaagagaaggctggaagaccccatgggatgctttaagggctaggcccagaagtgcaattacgtcatttacaaccacctctctttggccagaaccaggtcacacagctccgttctaactgcaaaggaggccagggcttagaagatctcgtggatatttggtgaatactggcagtcttgccatagtcaggaaacttcaaaaaggggaaaagatgccctatggccacactccactctggcccacaagctggcatcatccaatgacgtggccgatgtggcctcatttgttgcgtgggctggcaaaacccatattcaggttatacaggaatccttcattaaagtttagaggtcctttctcctccaaggcccagttctgttttttttaaaattaattttaaaatatttttccctttgatcttttaattaatgaactattaccatataacaaattgcccccaaaactcggtggcttaaaacaacaaacatttattatttcacagtttatgtgggccaggaatttgaatgcatattaactgagtggctctgattcaaggtctttgacgaggctgtactgaaggtgtggactggggttgcagtcatttggagaaatagcccagttggagttggaggatttgcttccaaattggctcgttcccgtggctgctggtgggaggcctcagtttctcatagtacaggtccctccacaggcctgcttgagtgtcctcatggcatgacaagtgatccaagagagagggtgacactggaccatggcgctttttatgccctggtctctgaaggtgcacaccgtcgcttttgccgtatgttactccagtagaagcaaatcactaagtccatcccacactcaaggaaaggacctaaactccaactcttcaaagcaggaatataaaagaatttctggaaatattttcaaactacaacagtctcccttgaatttattttggaacatgagtttccattccctacgaagaactgattgccccattaccatttactcatttaacttccccattgaactaatttatcgtattaaatcattatctagaaaagggcttgtcatgggccacctatttagttacattgacctgtctggctattgtcatgtccaagtacatttaaatttttcagaggtcataaaactttaagccagaccacaagctccctagtagcacagcctgtagacatataagggattatactatgttgtattaagtgcagggtcttagcacactatgaagtgtacatatgaagttgtactgcccttgagggcagtagcaactcgactgacagaggctctgcccgaagccaggcagtgatcatgctgaaggtcaggccaacgagggtgtgtgtgtgtgtgtgtgtgtgtgtggtgggagtgggagggtgctggggtaccaagaatggcagctgaactgcatcttttgttagagatccgaaactctcagcttgcgggactttacttcacaggcgtaagcacaatctgatggaaaatttgaatcctgaaaacgtgatatttcatctgtatctcatagacatggcacctggcaccgtcccagacagggcacatcatggggcacttggttagtggatgggttgtcaggtcagggaggcgacacaggatcacctgagcacatccaggacacctgccaggaccagccgtgtgaggctttcgactgtggcgggggcacctgctgtgctgaatggctggtttgtctctgggatttgggtagaaaacagagccaccaaggtggatgctcagtttcaagacctccaccctccactgggggaagtttcaattcagctgtggccatggggtccacagcaagacaccctcccaccccatgagacacagaaagaggaagaaggctgctatacgggaattaaaatataaagctccaggcataatacagagaatcagctcctgataaagtaagccaagagactgtctctacacacgtgactgagttatgctcgtcccagatccaaagctgaaagagcaggactggttcgggatttccatttgtcacctgtggctgatgctattgtctagctccccggtagccatccccacttctcttctgtttgactaacagagccccagaatttttccaagcagcaacacgcccagaccaatcagaattgatgtaagatgaacaagcacagcgactcccattctcctttcccagatactcaatttccctgcttgcagctaaaggaggccaggtgacctgtgtggccactgagatgtgtggggaactctgatatgagctttgggaaagattttaagattaaaaaagaaaaccaggcctggcatggtggcttactttgggaggccaaagcaggaggatctcttcagctcaggaattcaagaccagcctgggcaacatggtgaaaccccttctctaccaaaaatatcaaaaaaaaaaaaaaaaaatagccaagcatggtggcaagtgcccgtggtcccaaatactcgggaagttgaggtggaagaatcacttgagcctgggaggtgaaggttgcagtgagccgagactgcaccactgcactccagcctgggtgacagaatcagaccctgtctctcaaaacaaaagcaaaacaaacaaaacagcacagagaagaactggctggtactgcctcttcctgcgtcctcctatgtgatgcctgggcctcctccagtcttgtcaccatgaagccacacccaggaggccctaaaggcggctggctgatgagggcggagtaggagacgggtgtgacggttaatttggtgtcaacctgatgggccagatctttgggcaacatcttctggtgtttctgtggggtgttttgcatgagactggggggactgaggaaatcagattgttgctcctaatgtgggtgggcctcatccattcagacgaaggtctgaaaagaacacaaaggttgatctgccaagcaagagggaactccccctgcctagcagccttcaaacgagggcattggctatttcactcagcccgcagacaggaactaaaccatctgctctcctggatctccagcttgctgactcaccctgtagatcttgaggcttgctgcttttataattgcgtgagccagttccttaaataagtcagtctctatctctgcatctacttggttctctttcgccagagaatcctgactaatacatggtgtcagcctaggtcttcactgaccccactggtctggttcaccagcactgacctgcctgaactcctggcctcaagcgatcctccagcttcagcctcccgagtagctgggactacagactgaaattctaaggaagcaggtagatccccaaacaaactgttttttcctgaaaacaggaaagtcacaccaaccagttggaaagacctcagtttacctgagtcagcataatgaagaagtcccctctgctttaacttacaagaaaataacctgaagtaacctgatattaagcaatctgatttttttctattgttctgtttcctcgttcccaccttacaaagcccacagttctgctattgcccagtgggagctctccttctattttgaagaatagaggcttccctcattcataaaagccaattagatcttaaaaacaaatttgtgtaattttgtcttttgacagtacctaagagtgtatctgccataaacttctcaaggaattatgtgagcttctgagaaacaatagcttgctgaaaacagggaggcagcgagcatgagagtaatgtggaaaaatctcacgtggaaagaaagaatgggataaaaagctggatatgctgtaaacaaggtatctatttacaaagacacacagaaacttctgaacctttggacaaaaaagcgacgaagaaatttgtcaaagtgttgagcagttgcttctagttggtaggatttaaatattttagtctgtttgctttttatatcttttataaacaaagccctcttcactcctgtgtggctggcacaggagaacctatgtggacttaacaccctcttcgtatgcctcctttcccaccctccatttcgtctgtctacgaattcagcttcccaggaaccaaggaaagcagaagggagatgcctgtctacgtggagagttcagtcatgatacacaggattaccggctgtgactgactgagccagcatatgtgttgagcagtcagctgtgagtctgggtagcgtgagtctggtaaggcagacagacggaatttctgccttcttgtggcagagtcccttggcggggctggcaggactcagaaacaggggaaggcacatgccaacatccccactaactaactgaggccagcctctgctaggagcctcctgtgtcaagtgtggggcttaccacattatagctatctcactcaatccccaggacagcactgtgaggccagtgctgttggcagaaaggctgggaggtacagagcaggggagtccacatgtggctgtgatgaccaggagcccctcactaacagcagaggtgtggactggggtgaaaaacaaagacaaaacgtccacaggagtgttaacactacagaaataaaaagtgttagaagaggccgggtgtggtggctcacacctttaatcccagcactttgggaggccgaggcaggcagatcacctgaggtcaggagtttgagaccagcctgaccaacgtggagaaacccagtctctactaaaaaaaatacaaaaattagccaggtgtggtggcgcaggcctgtaatcccagctactcgggaggctgaggcaggagaattgcttgaacccaggaggtggaggttgtagtgagccgagactgcgccactgcactctagcctgggcaacacgagcaaaactcgtgcaaaaaaaaaaaaaaagaagaaaaaagtgttgggaggatggacagaagcatctggggaagactttgcaggtgaaaacggcagaactctcactacatgacaactttggtcaagctctgagagactttaccaaactctagcatggcttctaacagcgtaaggccatgtccctcagataaaaccagcgttccttcaagtgcctgcctgagaaagttcaatgtgccagggaatgactatttgtcttagctaacattcatctggtgataggcccttggactcccttactataaaaggcttacaattttaaatacagtcgtgcatcatgtaatggcaggaatacgttctgagaaatgtgttgtgagatgatttcatcattgtgtgaacatcatagagcgcgcttacacaaaccgagatggcacagccggctacacacccaggctgtatgacacagcctgttggtcctgggcggcaaacctgtactggggctaaaaacctgtacagcatgtgactgcactgaatactgtaggcaactgtgatatgatggtgagtatttgtgtatctaaacatatccaaacatagaaaagacacagtaaaaatatgatataaatgattaacaaatggtacaccaatatagggcatttaccataaatggagctgtggctactggctggtacagtattaggtgtacctgaagtatttgctgatgcctgcctctctgcctctgaggtttttctggaacaaacgccactgtagtcagctggcagtgatgaagcccagacattcagtaaattttaaaggggtatgggatcttgcctgccactggagcaggtcaggaggctcaaactatggctactgacctggattaagaggctttgggggtaagcctcatgcttggttttattgttgggggccaaatgttagggaacaaggcagaatcctatgttcacttccatctctcctccaagtggatggtatctctctctgtgctatgatacctgcagttgggggagaagtgattcaggtaattaaaactgtcctttctaccctctccaatgcatcttttcttattatgttacaaccatatactctgatctctcacctggtctccttagctctcatgaaggtatttatgtatgttgctagtcattctatgtgatgtttctgcagtgagacaacagctaaagagttctcttctgccatcttgctctgtccttcatcctactctatgtttcttcaaagataaattatgtgtatttgaggtttacaacatggcattatgggatgcatatagatagtaaagtggtactccagtgaagcagattaacatatttatcatttcagatagttactttgtatttttgtaataagaggagctaaaatatgcttatttaacaagaattcctaatacaatacaatttaactacttgacttcttatattgtacattagacctctagatattgattctacatatcgcctactttttatcctttgatctacatctccgcatttccttcgcctccctcagccatgataaccagttggttctctttttctgtgtttttgagattaaataagatcatgtaatgtttttctttttttaatttttaatggattttattggtgacgctagtgacttgctaattagcatgatgaatactggaaattggctctttttttgaatagagtcacactctgttgctcaggctggagtgtggtggcatgatcacagctcattgtaacaaactgggttcaaacaatcctcctgcctcctcttcctgagtagctatgactacatgatgttatgggactacaggcatgtgccactgcacctggctaattaaaaaaaattttttttttctagagacagggtcttgctatattgcccaggctggtcttgaactcctggcctcaagcagttctcttgcatcagactcccaaagtcctggaactacaggcctgagcccctgcacccagtcacattttcctttctgtgtctggattattcagttagcgtaatgtcctccaggtccatacatgttgtaacaagtggcaggatcttcttttctaaggtggaaaaatattccattatgtacatatatcatatttatgtacttgtctttctatggcatttacattgtttctatattttgacttttgtgaataatgctgcaataaacataagagtgcaaatatctttacaaggtggtaaagaagagggactgctgggtgatatggtgtattaatccattctcacgctgctaataaagacatagccgagactgggtaatttataaaggaaagaggtttaattgactcgtagttccacagggctggggaggcctcaggaaacttacaatcatggcagaaggggaagcaaacacatccttctttacatggcggcagcaaggagaagtgccaagcaaaagggggaaaagcccctttataaaaccatcagatcttgtgaaaatttacttactatcaggaaaacagcagcatgggggtaaccactcccatgattcaattacctcccaccaggtccctaccacgacatgtggggattacaggaactacagttcaagataagatttgggtggggacatagccaaaccatatcatatggcatttccatttttaattttttaggaaactttatttatttatttatttagataggatctcattctgtcacccaggctggagtgcagtggcatgatttcagctcactgcaacctctgcctcccaggctcaaacgatcctcccacctcagcctcccaagtagctgggaccacaggcatgcaccaccacacccagctaattttctgtatttttggtagagatggggttttgccatgttgcccaggctggtctctaactcctgagctcaagtgatccacctgcctcggcttcccaaagtgccaggattacaggtgtgagccactgtgcccagccaggaacctttataatgttttccataatggctgtatcaacctacactcccaccaaatattgtgcaggggttccctgttctccatacccttgccaacatttgttatcttttgtcctttaggtcctagctattctaatatgggtgaggtgatatctcgtagtggttctgatttgcatttgccttatgattagcgatgttgatcacatttttatatacctgttggccatttttgtgtggcttctttggtgaaatgtctattccagtcctttgcccatttttaattgggttatttttctgctattgtgttttaattgttctttataaattttaccctttatcagatatgtggttgcaattgttttctcaaagtttgtaggttgtcttttctctttgttgattgtttccttcggtgtgcagaagcattttagtttgaggtggtaccatttatatatttttattattgtgcttgagtttttgaggtgatacccaaattattgtcaaggccaacgttgaggagctttccctctgtgttctcttctaggagttgtatggtgtcaggttttatacttatgtcttttatccattttgggttgatttttgagcatggcataagataagaatctaattgtattcctttgcatgtgtaaatccagttttcccagcaccatttattggagagactatctgttcctcattgtgtcctcttgtgccattgtcaaaaattagttgaccatagatgtttggatttatttgtgggctctcttctctgttccactggtctgcatgtctttttttataccagcacaatactgtttttattactctagctttataatacaattttaaattaggaagtgtaaagccatcagctttgtttgtctttctcagtattgcttttgctatttgggttattttggctccatataggttttagaattgttttttctatttccataaacaatgccattggaagtttgatagagattgcattaaatctgtatattgctttgagtagtgtggacattttaccaatattaattcttcccattcatcaacacagaatatctttcaattcatttttgtcttcttcaatttccttcatcaatgttttaaaaatttctgaagactaatctttcatcaccttgttaaatttatccccttgttaaatttattcctaggtattttttgatgctatcgtaataggattttttcttaatttctttttcaaatacttgtttgttagtctatataattgccactgatttttatatgttaattgtgtatcctaaaactctactgaattcatttattagctctactttttttgtgtgtataatctttgcaattttctacacataggatcatgctatctgcaaatagagatagtttcacatcttttttatttggatgccttttatttctttttcttgtttgattggtcttgctaatatttctagtgctattctgaataaaattggtgagagtggacatttatgtcttgttctggatcatagaggaaaagcttttagttttaccccattgattacagtgttagctgtgggcttttttataaatgacatttattaagtagaggaattttagttttttctattattatactttaagttctagggtacatgtgtacaacgtgcaggtttattacataggtatacacatgccatgttggtttgctgcacccatcaactcgtcatttacattaggtatttctcctaatgctatccctctccgagccccccccacccccgacaggccccattgtgtgatgttcccctccccgtgtccatgtgttctcattgttcaactcccacctatgagtgagaacatgcagtgtttggttttctgtccttgtgatagtttgcttagaatgatggtttccagcttcatccatgtcccagcaaaggacttgaactcatccttttttatggctgcataatattccatgatgtatatgtgccacattttcttaatccagtctatcattgatggacatttgggtgtgttccaagtctttgctactgtgaatagtgccacagtaaacataagtgtgcatgtgtctttatagtagaatgatttataatcctttgagtatatacccagtaatgggatcactgggtcaaagggtatttctagttctagatccttgaggaatcaccacactgtcttccacaatggttgaactaatttacactcccaccaacagtgtaaaagcattcctatttctccacatcctctccagcatctgttgtttcctgactttttaatgatcgccatcctaactggcatgagatggtatctcattgtggttttgatttgcatttctctgatgaccagtcatgatgagcattttttcatatgtctgttggctgcataaatgtcatcttttgagaagcgtctgttcatatcctttgcccacgttttgatgggttttttttcttgtaaatttgtttaagttctttgtagattctggatattatccctttgtcagatggatagattgcaaaaattttctcccattctgtaggttgcctgttcactctgatgatagtttcttttgctatgcagaagctctttagtttaattagatcccatttgtcaattctggcttttgttgcccttgcttttggtgttttagtcatgaagtctttgcccatgcttatgtcctgaatggtattgcctaggttttcttctagggtttttatggtgttaggtcttacatttaagactttactccatcttgagttaatttttgtatacagtgtaaggaagggatccagtttcagctttctacatatgactagccagttttcccagcaccatttattaaatagggaatcctttaagcattgcttgtttttgtcaggtttgtcaaagatcagatggttgtaaatgtgtggtattatttctgaggcctctgttctgttccattggtctatatgtctgtttcggaaccagtaccatgctgttttggttactgtaggcttgtagtatagtttgaagtcaggtagcgtgatgcctccagctttgttctttttgcttaggattgtcttggctgtgcgggctcttttttagttccatatgaactttaaagtagttttttccaattctgtgaagaaagtcagtggtagcttgatggggatagcattgaatctataaattaccttgggcagtatggccattttcatgatattgactcttcctattcatgagcatggaatgttcttccatttgtttgtgtcctcttttatttcgttgagcagtggtttgtagttctgcttgaagaggtccttcacatcccttgtaagttagattcctaggtattttattctctttgtagtaattgtgaatgtgaggtcactcgtgatttggctctctgtttgtctattattggtgtataggaatgcttgtgatttttgcacattgattttgtatcctgagactttgctgaagttgcttatcagcttaaggagatttggggctgagatgatggggttttctaaatatacaatcatgttacctgcaaacagggacaatttgacttcctcttttcctaattgtatacccttcatttctttctcttggctgattgcccaggccaggacttccaacactatgttgaataggagtggtgagagaggacatccttgcttgtgctgcttttcaaaggcaatgcttccagtttttgcccattcagtatggtattggctgtgggtttgccataaatacctcttattattttgagatacgttccatcaatacctagtttattgagagtatttagcatgaagggctgttgaattttgttgaaggccttttctgcatctattgagataatcatgtggtttttgtctttggttctgtttatgtgatggattacgtttattgatttgcatatgttgaaccaggcttgtatcccagggatgaagccaacatgattgtggtggacaaagtttttgatgtgctgctggatttggtttgccagtgttttcttgaggattttcacatcgatgttcatcagggatattggtctaaaattctcttttttgttgtttctctgccaggctttggtatcagcatgatactggcctcataaaatgagttagggaggattccctctttttctattctttggaatagtttcagaaggaatggtatcagctcctctttgtacctctggtagaattcggctctgaatccgtctggtcctgggctttttttggttggtaagctattaattactgcctgaatttcaggacctgttattggtctattcagagattcaacttcttcctggtttagtcttgggagggtgtatgtggaatttatccatttcttctagattttctagtttattcgtgtagaggtgtttctagtattctctgatcgtagtttgtatttctgtgggatcggtggtgatatcccctttatcattttttattgcatctatttgattcttctctcttttctcctttattagtcttgctagtggtctatgtattttgttgatcttttaaaaaaaaccagctcctggatttattgattttttgaagggttttttgtgtctctgtctccttcagttctgctctgatcttagttatttcttgtcttctgctagcttttgaatttgcttgctcttgcttctctagttcttttaactgtgatgttagggtgtcaattttagatctttcctgctttctcttgtgggcatttagtgctataaatttccctctacacactgctttgaatgtgtcctagagattctggtatgttgtgtctttgttctcattggtttcaaagaaaatctttatttctgcctttatttcatacccggtagtcattcaggagcaggttgttcaatttccatgtatttatgtggttttgagtgagtttcttaatcctgagttctaatttgattggactgtggtctgagagactgtttgttatgatttctgttcttttacatttgctgaggagtgtttttacttccaattatgtggtcaattttagaataagtacaatgtggtgctgagaagaatgtatattctgttgatctggggtggagagttctgtagatgtctattaggtcagcttggtccagagctctgttcaagtcctggatatacttgttaaccttctgtctcattgatctacctaatattgacagtggggtgttaaagtctcccattattattgtgtgggagtctaagtctctttgtaggtctctaaggacttgctctaagaatctgggtgcttctgtattgggtgcatatatatttagcatagttagctcttcttgttgaattgatccctttaccattatgtggtggccttctttgtctcttttgatctttgttggtttaaagtctgttttatcagagactaggattgcaacctctgcttttctttttgctttccatttgcttggtagatcttcctccatccctttattttgagcgtatgtgcgtctttgcacgtgagatgggtctcctgaatacagcacacagatgggtcttgactctttatccaatttgccagtctgtgtcttttaattggggcatttagcccatttacatttaaggtcagtattgttatgtttgaatgtgatcctgtcattatgatgttagctggttattttgcctgttaattgatgcagtttcttcatagtgtcaatggtctttacaatttggcatgtttttgcagtggctggtaccagttgttcctttccatttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattcttttctttcagaatgttgaatattgacccccactctcttctggcttgtagagtttctgccaagtgatccactgttagtctgatgggcttccctttgagggtaacccgacctttctccctggctgcccttaacattttttcctacatttcaaccttggtgaatctgacaattatgtgtcttgggattgctcttctcaaggagtatctttatggtattctctgtatttcctgaatttgaatgttggcctgtcttgctaggttggggaagttctcctgcataatattctgaagagtgttttccaacttggttccattccccccgtcactttcaggtacaccaatcaaatgtatatttggtcttttcacatagtcccatatttcttggaggctttgtttgtttcttttcactcttttttctctgatcttgtcttcttgctttatttcattaatttgattttcaatcactgatatgctttcttccacttgatcaaatcggctactgaagcttgtgcatgcgtcacaaagttctcatgctgtgtatttcagctccatcaggtcatttaaggtcttctctacactggttattctagttagccatttgtctaaccttttttcaaggtttttagcttccttgtgatgggttagagcatgctcctttagctcggaggagtttgttattactgaccttctgaagcctacttctgtcaattcatcaaactcattctccatccagttttgttcccttgctggtgaggagctgtgatcctttggaggagaagagacgctctggtttttggaattttccacttttctgttctggtttctctccatcttgtggttttatctacctttggtctttgatgttggtgacctacagatggggttttggtgtggatgtcctttttgttgatgttgaagctattcctttctgtttgttagttttccttctaacggtcaggcccctcagcttcaggtctgtttggagtttgctggaggtccactccacaccctgtttgcctgggtatcaccagtggaggctgcaaaacagcaaatattgctgcctgatccttcctctggaagcttcatcccagaggggcacccacctatttgaggtgtctgttggcctctactgggaggtgtctcccagtcaggctacacgggggtcagggacccacccgaagaggcagtctgtccgttcttggagctcaaatgccatgctaagagaaccactgctctcttcagagctgtcagacagggacgtttaagtctgtagaagctgcctactgacttttgttctactatgccctgccctcagaggtggaatctagagaggcagtaggccttgctgagctgcagtgggctccgcccagttcaaggttcctggctgctttgtttacacagtgagccactcaagcctcagcaatggtggacactcctccccctgtcaagctgcagcatcgcaggttgatctcagactgccgtgctggcagcgagcaaggctctgtgagcatgggacccagcaagccaggcacaggagggtatctcctggtttgccagttgctaagaccgtgggagaagtgcagtatttggctaggagtgtactgtttctccaggtatagtctgtcatggcttcccttggctaggaaagggaaatcccctgccccttgtgcttcccaggtgaggtgatgccctgccctacttcagcttgccctccatgggctgcacccactgtccaaccagtcccagtgagatgagccaggtacctcagttggaaatgcagaaatcactcatcttctgcattgatctcgctgggagctgcagaccggagttgttcctatttggccatcttagaagcgacccacaatatctagttttttttgagatagagtctcactctgtcacccaggctagagtgcagtggcgcaatcttggctcactgcaacctctgcctccagggttcaagtgattctcctgcctcagcctcccgagtagctgggattacaggtgtgtgccaccacgcccagttaatttttgtatttttagtagagatggggtttcaacatgttggtcaggctcatctcgaattcctgacctcatgatctgcccgcctcggccttgcaaagtgctgggattacaggcgtgagccactgctcccggccagaattttacttttatacatgaattgttaagagttttttgttcgttttgagaaggaatctcactctgtcacccaggctgcagtgcagtggtgcaatcttggctcactacagcccctgcctcctgggttcaagtgactctcctgtctcagcctcctgagtagctgggactacaggcacacaccattacctctggctaatttttgtattttcagtagagacgggatttcaccttgttggccaggctggtctcgaactcctgacctcaagtgatctacccacttcggcctcccaaagtgctgggtttacaggtgtgagccactgcacctgaccattaagagttttttaaatcaagaatggacgtggaattttgtcaaatacttttctgtgtcaattgagataatcatgtggttttctgtttttcgtgctgtaaatgtgatgtattacattgattgagtatgttaaccagcctttcatgccaaggataaatcccacttggtgatgacgtatactgtttttgatgtgtttgatgaatttggtttgctaatatttgactgaggagttttgcattatatgagttattggcctatagtttttttttttttttttggcctaaagacacctattgtggtgtctttttcttgcttagttgtgaaagtgatgctggccttgtaaagtatgttgtaagtattctcccagctctattttctgggacagttaagtggtaataattcttctttgaatgtttggtaaaattcagccataaagccatctggtcccaagctttatttctgttggaaggtttctaattacttcttcagtgtctttatttattattataatagtttgttcaagctttctatttcttcctaatttattcttaaaagttactgttttatagtagtttattaacttttataagttgtgccatttgttggcagatgctttttcataattgtttattatgatgttttttatttttgaggcatgtattgtatggtcttcatttatatttctgattttatttattccagtcttttttttttcttagtctatcttggaatttgatattatttatttttcaaggctgggcacagtggctcatgcatgtaatcccagcactttgggaggccgaggcagcggatcacccgagaggtcaggagttcgagactggcttggccaacatggtgaaaccctgtctctactaaaaatacaaaaaaattttctaggcatggtggtgcacgcctatagtcccagctacttgggaagtggaggcaggagaattgcttgaacccaggaggcagaggttgcagtgagctgagatcatgccactgcactccagcctgggcaacagagcaagactctgtctcaaaaaaaattatttttcaaagaatcaagtcttggttttattagtttttttcacatggtttttctgttctctatttgatttatttctgctctgatattattgttcccttccttcagttaactttgggtttaggtttctctttttctagctccttagggcataacattaaattttttgattaaggtatttcttcttttttaatgtaggcatttatacctataaagttcccctttagaaccacttttgctacaccccatgggttttgatatattgtatttttattgtcattcatatcaaaatttaaaaaattccttctgtatatgtgctactgaagtgagcacttttaatttacctttgattcttatttgatccattgatttttcagaaacatgctgtttaatttccacatatctgtgacttttccaaaatttctcctgttactgatttctaattttatactgtcatggctgaaaacaataccattatgattttaatcttcttgagtttgctaagacttgttttatggcttcatatttggtttatcctggataatgttccatgtacactaggaaaaatacacattcttctgtctgtacatatctgtttaagtccatttgctctaatgtacagttcaaatccagtattttcttgttaattttctgtctggttcatgtatctatttttaaaaaggggtattgaaccagagaacaccacaaagatactcctcaagaagagcaaccccaagatacataatcatgattcaccaaggttgaaatgaaggaaaaaatgttaagggcagccagagagaaagatcaggttacccacaaagggaagcccatcagactaacagcggatctgtctacagaaatcctataagccagaagagagtgggggccaatattcaacattcttaaagaaaagaattttcaacccagaatttcatatccagccaaactaagcttcataagcaaaggagaaataaaatcctttacagacaagcaaatgctgagagattttgtcaccaccaggcttcccttacaagagatcctgaaggaagcactaaataggtaaaggaaaaaccagtatcagccactgcaaaaacataccaaattgtaaagaccatcgacactgtgaagaaactgcctcaactaatgggcaaaataaccagctagccccagtcagtgactggcaagatggccgagtaggaacagctccattctgcagctcctagcaagatcaatgcagaaggcaggcgatttccaactgaggtacccggcttatctcagtgggactgattagacagtgggtgcagttggtggagggtgagtggaagcagggtggggcattgcctcaccgaggaagtgcaagaagttggggaacttcctcccttactcaaaggaaaccatgagggactgtgctgtgaggaacggtgcactctggcccagatactacacttttcccaaggtctttgcaacgcacaaaccaggagattccctgggtgcctacgccaccagggcccagggtttcaagcacaaaacttggcaggtgtttgggcacacactgagctagctgtaagagttttttttttcataccccagtggtacctggaatgccagtgagacagaaccattcactctcctggaaagggggctgaagccagggagccaagtggtctagctcagtggatcccacgcccatggagcccagcaagctaagacccactggcttgaaattctcgctgccagcacagcagtctgaagttgacctgggatgatagagcttggttgggggagagttgtctgccattactgaggcttcagtaggcggttttcccttcagtgtaaacaaagccaccaggaagttcaagctgggcaaagcccaccgcagctcagcaaagcggctgtggcccgactccctctctagagtcctcgtctctgggaaggggatctctgaaagaaaggcagcagtaccagtcagggacttatagataaaactcccatctcactgggacagagcacctgggggaaggggaggctgtgggcacagcttcagcagacttaaacagccctgcatgccagctctgaagagagcagcggatctcccagcacagtgttcgagttctgctaagggacagactgcccttcaactgggtgcctgacccctgtgccttctgattgggagacacctcccagcaggggtcaacagacacctcatacaggagagctctggctggcatatggcgggtgcccctctgggacgaaccttacagaggaaggagcaggcagcaatctttgctgttctgcagcctccacttgtgatccccaggcaaacagggcctagagtggacctccagcaaatttcagcagacctgcagcagaggagcctgactgtcagaaggaaaactaacaaacagaaaggaatagcatcaacatcaacaaaaaggacatccacacagaaccccatctgaaggtcaccaacatcaaagactaaaggtagataaatccacgaacatgaggaaaaaccagtgcaaaaaggctaaaaattccaaaacccagaatgcctcttctcctccaaagcatcacaactcctcgccagcaagggaacaaaactggatggagaatgagtttgacgaattgacagaagtaggcttcagaaggtgggtaataacaaactcttccaagctaaaggagcatgttctaacccaatgtaaggaagctaaaaaccttgaaaaaaggttagacgatggctaattagaacaaccagtttagtgaggaacataaaggacccaatggagctgaaaaacacagcacgagaacttcatgaagcatacacaagtctcaatagccaaatcgatcaagtggaagaaaggatatcagagattgaagatcagcttaatgaaataaagcatgaagaccagattagagaaaaaagaatgaaaagaaatgaacaaagtctccaagaaatatgggactatgtggaaaaaccaaacctacgtttgattggtgtacctgaaagtgacagggggaatggaaccaagttggaaaacactcttcagcatattatccaggagaacttccccaacctagcaagacaggccaacattcaaattcaggaaatacagagaacaccacaaagatactcctcgagaagagcaatcccaagacacacaatattcagattcaccaaggttgaaatgtaggaaaaaatgttaagggcagccagggagaaaggttgggttacccatgaagagaagcccatgagactaacagtggatcactcggcagaaactctataagccagaagagagtgggggtcaatattcaacattctgaaagaaaagaattttcaagcccgaatttcatatccagccaagtaagcttcataagtgaaggagaaataaaatccttaacagacaagcaaatgctgagagattttgtcaccaccaggcctgccttacaagagctcctgaaggaagcactaaatatgtaaaggaaaaaccagaaccagccactgcaaaaacatacctaattgtaaagaccatcaacactgtgaagaaactgcatcaactaatgggcaaaataaccagctagcatcataatgacaggatcacattcaaacataacaatattgaccttaaatgtaaatgggctaaatgccccaattaaaagacacagactggcaaataggataaagggtcaagacccatctgtgtgctgtattcaggagacccatctcatgtgcaaagacgcacataggctcaaaataaagggatggaggaatatttaccaagcaaatggaaaggaaaaaaaaagcaggtgttgcaatcctagtcactgaaaaatagattttaaaccaaccaagatcaaaagagacaaagaagggcattacataatggtaaagggatcaatgcaacaaggaaagataactatcctcaacatatatgcacccaatacaggagcacccagattcataaagcaagtttttagagacctacaaagagacttagactcccacacaataatagtgggaggcgttaacaccccactgtcaatattaggcagatcaatgagacagaaaattaagaaggatattcaggaattgaactcagctctggaccacggagacctaacagaaatctacagaactctccaccccaaatcaacagaatataaattcttctcagcaccacattgtacttattctaaaattgatcacataattggaagtaaagcactcctcagcaaatgcaaaagaatggaaatcataacaaacagtctctcagaccacagtgcaatcatattataactcaggattaagaaattcactcaaaaccacacaaatacatgaaaactgaacaagctgctcctgaatgactactggataaataacaaaattaaggcagaaataaataagttctttgaaaccaataaaaaaggcacaatgtaccagaatctctgggacacagctaaagcagtgtttagagagaaatttacagcactaaatgcccataggagaaagcaggaaagagctgaaactgacaccctaacgtcgcaattaaaagaactagagaagcaagagcaaacaaattcaaaagctagcagaagacaagaattaactaagatcagagcagaactcaaggagctagagacacaaaaacccttcaacaaatcaatgaatccaggagttgttttagaaaagattatcaaaatagatagactgctagccagactaataaagaagaaaagagagaagaatcagacagacatagtaacaaatgataaaggggatatcaccactgatcccacagaaatacaaactaccatcagagaatactataaacacctctatgcaaataaactagaaaatctagaagaaatggataaattcctggacacatacaccctcccaagactaaaccagaaagaagtcgaatccctaaatagaccaataacaagttctgaaattgaggcagtagttaatagcctaccaaccaaaaaaagcccaagaccagatggattcacagccgaattctaccagaggtacaaagaggagctggtatcattctttctgaaactattccaaacaatggaaaaagagggactcctctctaactcattttatgaggccagcatcatcctgataccaaaacctggcagagacacaacaaaaaaggaaaatttctggccaatatccctgatgaacattgatgagaaaatcctcaataaaatattggcaaaccaaatccatcagcacatcaaaaagctaatccaccatgatcaagtctgcttcattcctgggatgcaaggctggttcaacacacacaaatcaataaatgtaatccaccacataaacagaatcaacgacaaaaaccacatgaatatctcaatagatgcagaaaaggccttcgacaaaattcaatagcccttcgtgctaacaactcctaataaactaggtattgatggaacgtatctcaaaataataagaggtatttataacaacccacagccaatatcatactgaattggcgaaagctggaagcattccctttgaaaaccagcacaaggcaagcatgccctctctcaccactcctattgaacatagtattggaagttctggccacagcaatcaggcaagcggaagaagtaaagagtattcaaacaggaagagaggaagtcaaattttctctgtttgcagatgataggatagcatatttagaaaatcccagcatctcatccccaaatctccttcagctgataagcaacatcagcaaagtctcaggatacaaaatcaatgtgcaaaaatcacaagcatttctatacactaataatagacaaacagagagccaaatcataagtgaacttccattcaaaattgctacagagagaataaaatacctaggaatacaacttacaagaaatgtgaaggacctcttcaaggagaactacaaaccactgctcatggaaataagacaggacacaaacaaatggaaaaaacattccatgctcatggataggaagaatcaatattgtgaaaatggccatactccccaaagtaatttatagattcaatgctattcccatcaagctaccattgactttcttcacagaattataaaaaactactttaaatttcatatggaactaaaaaagagcccgcatagccaagacaatcctcagcaaaaagaacaaaactgaaggcatcatgctacgtgacttcaaactatactacaaggctacagtaaccaaaacagcatggtactggtacgaaaacagatatatagaccaacggaacagaacaagtcctcagaaataacaccacacatctacaatcatgtgatctttgacaaacctgttgaaaaacaagcagtggggaaaggattccctatttaataaatggtgttagaaaattggctggccatatgcagaaaactgaaactggattccttccttataccttattacaaaaattaactcaagatggattaaagacttaaacataaaacctaaaaccataaaaaccctaaaagaaaacctaggtaatactattcaggacataggcatgggcaaagacttcatgactaaaacaccaaaagcaatggcaacaaaagccaaaatagacaaatgggatctagttaaactaaagagcttctgcacagcaaaagaaatgatcatcagagtgcacaggtaacctacagaatgcgagaacatttttgcaatctatccatctgacaaagggctaatatccagaatctacaaagaagttaaacaaatctacaagaaaaaaaaatctgatcaaaaagtgggtgaaggatatgaacagacacctctcaaaagaacacatttatatggccaacaaacatgaaaaaaagctcattatcactggtcattagagaaatgtaaatcaaaaccacaatgagataccatcttgtgccagtgagaatggtgatcattaaaaagtcaggaaatgacagatgctggagaggatgtgaagaaataggaatgcttttagcctgttggtaggagtgtaaattagttcaaccattgtggaagacagtgtggcgattcctcaaggatctagaacaagaaacaccatttgactcagcaatcccattactgtatatacccaaaggattacaaatcattctactataaagacacatgtacacatatgtttattgtgacactgttcacaatagcaaagacttggaaccaacccaaatgcccatcaatgataggctggataaagaaaatgtggcacatatatactatggaatactatgcagccataaaaaaggatgagttcatgtcctttgcagagacatgggtgaagctggacaccatcattctcagcaaactaacacaagaacagaaaaccaaacagtgcatgttctcactcataagtgggagttgaacaatgagaacacatggacacagggaggggaacatcacacaccagggcctgtcggagggtagggagctaggggagggaggggtagcattaggagaattacataatgttgatgatagtttgatgggtgcagcaaaccaccatggcacatatatacctaaacctgcacttcctgcacatgtatcccagaacttaaaatataataataataataataaaggggtattgaaattccccagtatttttgttttgctatgttttcctcatgtccactaatatttgctttatatgtttacacaccttgatgttggttgcatatttataattgttacagtctgattaacttatttgcttattattacttaaagacaatcttagtctcttgtaacagtttttgacttctggcctactttatctgacataaatatagtcacccctgctttctttttttaccgtttgcatgaaaaaattctttcttttcactttatttttgtccttaagcttgatctagtctgccattgaagctctctattgtattttttcatttccttcattgaataatctaatggcaagacatctgtttaatttttcttgatgtctatttctttgctgaatttctaatttataccatgatttttttttcctgatttctttcaatagtctatctatattatcttgaatcttgctgactttttattttttatttattttttatttttttaattatactttaagttttatggtacatgtgcacaacgtgcaggtttgttacatatgtatacatgtgccatgttggtgtgctgcacccagtaactcgtcatttaacattaggtatatctcctaatgctatccctcccccctccccccaccccacaacaggccccggtgtgtgatgttccccttcctgtgtccacatgttctcattgtttgattcccacctatgagtgagaacatgcagtgtttggttttttgtccttgcgatagtttactgagaatgatgatttctaatttcatccatgtccctacaaaggacatgaactcatcattttttatggcttcatagtattccatggtgtatatgtgccacattttcttaatccagtctatcattgttggacatttgggttggttccaagtctttgctattgtgaatagtgtcgcaataaacatacgtgtgcatgtgtctttatagcagcatgttttataatcctttgggtatgtgcccaggaatgggatggctgggtcaaatggtatttctagttcaaatcttgctgacttttaaaaatgttatattattattattattattattattattattattattttgagatggagtctcactctgtcaaccaggctggagtgcagtggcacgatctcggctcactgcaacctccacctctcagattcaagtgattttcctgcctcagcctttttggggagagtcatgtttctttgctttttcatgtttcttgtgtccctgtgttgatatatgtgcatctggtagaacatttgcctctcctaacttataaagtagcttttctaagaaaaaactttcacttgttgataggtcctcgggtgctgagtagggtgtatcggctctgcttctggctggcacagtagcgtagtctctgtgaagcttctcagctataatcaatgtcagtgacaagtggatgcctcagtggcccgtactgcagtaatttgtgggagtggtggtagcaaagtagattacactgagctcaggcaccaagagagcacaactactccaccagctcaggtacagcttccctcgggtgggatgcagggctggtttgtgtgctgagggaataagaccagtgttctggcttgggcatagcttttctggaggtggggcaccaggccgctttatgtgccaagggagcacagctgctccaccatctcagacattgctttcctggggctgagtctggggcccccagttagtgtgcacacaagggggtattgttgccattctattgcgcatgcttctctggggtcaaggtgcttggctcatgcttgagagggtacaactgcttcaccaggccaggcttggcttccttgctgggttggactgtttggtccttgggggccagagcagcctgtaggttcagaagcctgggtcatgaccgttccactgggcctaggcctaggcttcgaatggccatgggtggggcatagctgccactggaatggagaggatactgtgccttctcagcagcttcataaaaaggtattttggtctatatatccttggtaaatctgtatttctgagacagcatgagatcaataattttctattctactctcttgcttacaacattcaacaactcatttcctttttttttttatcacagagtaatattccattgtatagatgtaccatagtttgtgtatacattctatgtatcattattgaatgatatctggttgcaaacatttttggcaattatgaataaagctgctataaacattcatgtgcaatttttcatgtggacatatgttttcaagtcatttaggtgaataaaaagcagtgcagttgctggattaggtgataaaagtatgtttaattttgcaggaaattgctgaactgtcttctagaacaaccgtaccgtcttgcattcctgtcagcaatcagtgagaattcctgttgctccgcatcctcaccagcatttggtgttgtcagtgttctagattttagactaaatgcagtgttttcattttgtcctattctagatgctaacttttattgtgatttagtctcgtgagttgttttaaattgttacataagaatttcttagtgtatagagtttcctatgtttttgaattactttttaattttaattgcattatgattagagtatgtttattttgatggttatctgtggaaattttcattctgatctagttaagtggtgactttgtgagtttccgtgtgcttaaaaagactgcaaatctctcattgtggctgccctggaacttagtttatataataaataagtttcctcatgtctgaacctgcccaggcacctttcccaatgtatcagatgtttaacactaaggatctgttttgttctggaaagttatttttatctggcctcatgattacagtcctggccctgaacttcagagaatggaggggtaagcaaaaggacctcagactgtgccaggaaatgtcaagtcacctgctgtaggctactactaatggagcatggcctatttacttggacaccaaactatccagtgctaacatgaggtttttcaggactagatcccatggccatacagccctgcctgccagattggacgtgaaaagtatttccgcatctgacattcctgtttcacccacacagggcatcgttttgcccaggacaaagttcacctccaatcttatccacactatttctatctttgcttccttgataagatatagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaaggtctttgcttgtttatttcacatgaatttattgttccctacttcaaatcacccatgaaacaggcacctgctctgtgccagagccagagggaaggtggcacttccattgcattctatagagcccgcattactttcataccaaaaccagacaaggacattacaagaaaagaaaggaaaactacacgtccatatcccccatgaacttagacacaaatattctaattaaaattttagcaaactgaatccagcaatacattcaaagaataatacatcactactaaatatgttttttctcatatgtggcttaatattcaaatatcaaccagtttaattaaccacattaacaaactgaaaaagaaaactatacgatcatttcaatagatgcaggaaaaaattacatctgtgagcaaagaagctacacagatgacaggcacatgaaaagatactcaacatcatagtaattgagacaattcaaattaaaacaatgagataccattcctacctattggagtggtaataaaattacacagaatgatcatacccagtgttggccacaatgtgcagaaactgaaactcacaccctgctgataggaatgtaaaagagtgtaaaaatgtaaaaactattttggaaaactgtatggcagtttctttaaaagtaaacagtcacctaacgtatggtccagccatcccactcttaagtattcaccaagagaaaaggaactgcatgtcttgacaaagccttgtacctcaatattcatagaagcctcattcagaataggtgaaaggtggagacagcccagatactcacaacagatgagcagataaacaaaccgtggtgcatccacgcatcaggcgctccatgacagtcaaaaatcaactcttcgggcaggcagtgaagggtcgtcacacagcagctgtgggtgcagaaggtggtggattccatggtggagagtctggacagagagaacatccagaagatccaggtgagcagcccgaggcccagccaaggcgtggccagggtgaaagacaagaaaggcgaaggctcctggccttcgaacctcatcctttgagtgctatgcccacatttaaatatacatgctttattttaaagagcagttctaggttcatagaaaagtcacgtggaaagtacaaagagttcccatataccctctgcccacacaggtgcatagctctccctactgtccacatcccaccaagatggaacattgtaactatcaataaacctatgttaacacctcattatcacccaaagtctgcagctgacattagcgttcactcttggtgttgtacattccatgggttttggcaaatggataatgacatggatctatcatcactgcatcacacagatgctttctttgccctaaaaatcctctgtgctctgctattattcatgcttccctcaccactaacctctggcaaccactggtctttttactatttccagagatttgccttttctggaatgtcatataattggagtcatacaatatgtggtctttttagattgttttctttcactttataatataaacagtcacatttttaaaatcacagtgatatgcctgatacactactattgctttattgattttatgtaatgtccaagtctgtaggtactcaggtacctgagtacggacagtgtcaagaggaggagagggatgtgcttcttaatgcagcatttgctgagtgagaagaggtgaccaccccaggagctgccaatgttcaatcccttctggccttagcccagggagcttgagggtgattgaagtggaaatccacagggtcttccacagtcccttctccccagtgctggtagagtgtgtcttaaagcagctgtagatggaatactacttggttaaaaagaaggaacaaactattgatacatgcaacattttggatgtatcttgtaggcggcatattcagtgaaaaaagtccatctcaccaagttcataggatatgactccatttatatgacattctcaaaatcacaaaattatagagaggaagaaaaataagtggtttccaggaattaggaaagggggagagggtgtgtgttttagtctgttttcacactgctataaagaactacctgagactgggtaacttataaagaaaagaggtttaattgactcagttctgcacggctggggaggcccaggaaacttacaatcatggcaaaaggcaaaggggaagcaaagcacgtcctacatggtggcaggagagaaagagaacaacgtgggaactgtcacacgcttttaaaccgtcagatgtcgtggaactcactccctatcatgagaacagcatgggggaaccacacccatgacccaatcaccttacaccaggtccctcttttgacacatggggattataatttgacatgagatttgggtggggacaagagtcacaccatatcagagtgatttatagatgcacattgagggaggtcttcaatagtgatggaatagtatgttttttccttgagacagggtctcggtctatctcccaggctgcagtgcagtggtttaagcatagctcactgcagcctcgaatttccaggcttgaacgatcttctcacctcatcctcctgagtagctgggaccacaggcatgtgccaccatgccctgctacttttttgacttttatttttagtagagatgaggtttccctgtgttgcccaggctggtctcaaactcttgggctcaagggatcctcctgcctcagcctcccaaagtgctaggattacaggtttgagccactgtgcttgttctggaacagtatcttgtttatgatggtggttacttgaatttatatatctaataaaattgcacagaaccacatgcatgtgcacacacacacacacacacacacacacacacaaatgaatgcatgtaaaaactgctaacatgtgaatcaggcctggagtctagttaacatatttatatcaatatcaatctcctggtttcaatattgtgccatagcaaagctacataagatgttgccattgccttaattttaaaaaattgttaccattggagaaagcttggtgaagggtactcaagactcaacaatttttgcaatttcctgggagtttatatgactgtttcaaaataaaacaaaaatttgtaaagcagctttaaaaaaacaacatttattttaaaatgaagttgggttgtcgaaataaataaatgtgtgtgaaacagagtttcagagattcaactggtatcagctcacatcaaatgacaatgaaacagaagacttaaaaaaatttctgtagctttgagtatcagaacaactatcttcaacaaatcaaaattgaatgatgccattagctgtgccatccaaagtaaataaggactaaaatcatgaataagaaaacttggaataataggtgataaagctaacattaatgtaacatggtagtccgactagaaacaataagtgccaatataacgaattcccctgcaaaacatccccaccaccaagttagttttcattataaagatgattaaaacaaactaaagcagccacagacaggaacaccgggcctgcctcctggtgcagccgtctgagcttcccaccttaggacagcagtgggaagcaggatggtggggcccaagtcaggagctaagtccccctactgtgcctggggaaggatgcaaggctcctgaggcacctcaggagaggaagcagagagggttgtagtcgatgagctgagtctggaggccagagggagccgagggtctaggagcacgtggtgagtggcagagatgctggtaggctccctgtgtgtttttcagggagtaataaatacaagcccagaaactaccaggagccaggcattagagatatgaggatggactgctgtgaactgtctaggaacaaaatagctgaaagggcactgtggaagaaggtgtcagaaaattaacttctgaaaggaaaggagagagggctaggaaggccttgggcagccaagttcatacagagacgtgtgtgtgtgcatgtgtgtgtgtgtgtgtgcgcgtgatgtaaggagaaaggaggaaagaagtgggggtaaaagtgaaattttctgagctattctgtggtttttttctctgacatgaccaaaataggaagaaaaagaaaataaaactaaagaaaaaaacaaaaaaaaattcacacacaaaaaaggagcagcaatgtcactcacacatgaaacctgacttcacatcccagatctgcttgggatgcagaagtccatttgactgttaaaaatgtatttttatcaaagtgatgcaaactaatatttaaaggagtttttaggtccggtgcggtggctcacatctataatcctagaactttgggaggccaggtgggtggactgcttgagcccaggggttcgagaccagcctgggcaacattgcaaaaccctgtctctacaaaaaatacaaaaaattagccaggtgggtggtgcatgcctgtggacccagctactcgtgaggctgacaggaggattgtttgagcctgggaggttgaggctgcagtgagctgagatcacgtcactgcactccagcctgggtgacaaagagagaccctgtctcaaaacaaactaacaaacagaatccccccccaccacaaaaaaccaaaccaaaaccatgatttttaaaagcattgtaataaaaagcaatagtaccccaatgccttactactgtgtccctttccaacccaccccagtgttgtacccacagggaaaactttatggcttctctttttggttgtttttccttatagctaagttacttgtttcttcttctggcattttattttatttatttatttatttaattttttttttcgagtcagagtctcgctctgtcccccaagctggagtgcagtggtgcgatctcggctcactgcaacctccacctcccgggttcaagtgattctcctgtctcagcctcctgaggagctgggactacaggcacccgccaccacacccagctaggctaatttttgtatttttcgtagagacaggttttcaccatgttggccaggctggtctcaaactcctgacctcaggtgatctgcccacctcagcctccctaaaagggctgggattacaggcatgacccactgcgctcagctattttgttttatttttaattgacaaaaattgtatatatctgtcgtgtgtaagatgttgtattgaaatatgtatgcagtgtggaatggctatagacagctaatcaacatatgcattacatcacatacttatcttttttgtgatgagaacacatgaaatctattgtttcagtaattttcaagaatacaatacattgttactaactatagtcaccaggttgtataatagatctcttaaacgaattcctcctaactcaaactttttaccttttgaccaacatttccccaaacttcccacatactcagcccctggagaccaccatgctattttttacttctgttagttcaacttttctagactctacatatacataagatcatgcagtatttctttttctgggcctggcttatttatcttaatataatgtcctccaggtttatctacgttgtcacaaataacaggattttcttcttttttaaaggttcatactacttcattgtgtatctatatacatacatagtgtctacccacacataaatacacaaacacaatgttgaatattttcttcggagaaatgtttatgtatatatacaatattttctttttctttccttttttttttttttttgagacagactttcactcttgtcggccaggctggagtacaatggcgcgatctcggctcaccgcaacctccgcctcctgagttcaagcgattctcctgcctcagcctcccaagtagctgggataacaggcatgggccaccacgcctggctgatgcctgtaatcccagcactttgggaggccaaggcaggtggatcatctgaggccaggagttcgagaccagcctggccaacatggtgaaaccccatctctactaaaaatacaatattttctttatctctttatctgtttacgggcgcctgggttgattccatttcttggctgttgtggataatgctgcatggcagtgcagatatctcttcaatataccaatttaaattcctttgcatatacacccaggagtaggattactgaatcataaggtggtcatatttttaattttggggggaatctccatgctgttttcgataatgactgtactaatttacattcccaccaacagggtgcaagaactctcttttctttacatccttcacacctatctttcatcactttgataatcgctattcaaacaggtgtgagtcaacatcccactgtgattttagtttgcatttctcccatgactggtgatgctgagcattttttcatatatgtttcaaacatttaaatggtttctttagagaaatgtctattccagttctttgcccattttttaatcgtcttttttttttttttttgctgtttagtcaaattcttatatattctggtcagaaattccctattggatgtctagtttgcgaatattttctcccattgtgtgggctgtcttttcactctgttgtttcctttgttatgcagaaactttttgaattgatataatctcatttatctatttttgcttttgttgcctgtgcttttgaggttttacacaaacaaaccattgcccagatcaatgtcctgaagcatttccccagtattttcttctagtaattttatagttccaggtcttatatttaagtttttgatccattttaatttgattttttatatggtgagagatggggcatccagttcattcttctgcatatggatatctatttttcccagcactatttattgaagagactgtcctttccccaacatatgttcttgctgcctttgttgaaagtgagttgactgtaaatgtatggatttgttttgggattctctattttgttctgttggtctgtgtgcctatttttatgtcactaccacgctgtttggttaccaaagctttgcagtaaatttggaagtcaggtagtgtgatatctccagctttgttctttttgcttaggattgctttggctatgtgaggtcttttgtagttccatacaaattttaggactctttttctatttctgtgaagaatgtcactggcattttgatatggattatattgagtctatagattatttttggtagtatgaatattttaacaataataattcttccaatccataaacattagaaatctttccatttgtttgtgtcctcaaacttcttttatcagttttttatagttttcattttagaactttttcacttctttggctaaatttattccttgctatttaaatttttggtagctattgcaaatgagattgctttcttgatttctcttccagattgttcactatcggcatctataaatgctactgatgtttgtatgttgattttgtatcttaaaactttactcaattcatttatcagtgccaagagtttttttgctggagtgtttcagtttttctaattataagattatgtcatttgcaaacaagaacgatttaacttcttcctttccaatttgaatggactttatttctttccctcgcctaattgctcttgctagggcttccagtactatgctgaataaaagtattgaaagtggacacctctgtcttcttctagctcttagaagaaaggctttcaggtttttctcctaataagtatgatgttagctgtggatttgtcatacatggtctttattgtgttgaggtattttctttgtatatccagtttcatcatgaaggcacgttgaatcatgtaaaatgctacttctgagtctattgagatgatcatatggtttttgtccttcattctgttcatgtggtgtatcccatttattgatttgtgtgtattaatccatccttgcatccctgggataaattccacttgatcatggtgtgttatctttttgctgtgttgttggaattggtttgctagtatttttgcatctgtgttcattcaagatattggcttgtagttttctttttttgttgtgtctttgtctagctttggtatgagggcaatgctggccacatagaatgacttagggagagatcctgcctctacaacttttgcaaatagtttgagtagaaatggtattaattcttcttttaaagtttggtagaatttgtcagtaaagccatcagtgatgtaacctgtccccaagtctcccagcaatgggtaccagcaccagctctgatgagggtggcaggggagtaacgtagactctgagattcctttgttataaataggcttagtatattggctttctcaaatgttggttacggtagtaatgaactgttcacctggacagactaggacccactggttagtcaggacactgtgggaaatggtgatagctgaggtcacacacaagtgttcttcttcctgggtgctctgttactcctcctggagctgctgtaatggactgactgtgtcagttggcctctagcttggaggtgttgcttggaaaagagcaccagctgcggtagtagcagtgggatttatacttgccttatgttacccagggggtactgtggtgtctcaggcaatgggaggggccataaaattcccaaaagtttccgtcctttgtgttaagctaccagggtaggtggaggggcaaaaccaggtggaggctgggtcaggcgggtccacgtgctggctctccacatgcaaggcaaacaatggctcttgtgggggttgagggtggttctcttgccactaggacaatgttccagggaggggtgcagctgcctctattgcacagaagagtttacacagggagtggggagtagcaggtggcataagccccacacagtcccacgtacttggcaaggcaaacctcacgcccagagtgttccactagcagcggctagctaagttccaggcagtttgtgctcagaactcaaaactgctccaggccataagcctttctggcagagacagcaactgcggcatttaggccatgcccttcccagtctgccagcaaagccagggtgcccagcttctgcactcatggatgcagcacgcttttcactcacctcccacttctggcaaagaaagttcatccccactcgagagaatatcatgaattttagttagaagcttttcttaacctgtgactgctgcctgaataagctggccgacttctgtgaggtcccctgggaggcaggatcaggaatggcttccttcgtccacactggaggctgggaatgcatgcaaggctcttgtgctggtgctcctaattttttgttccccactactccctaaaccagtttcagggctggatagaattaaggccttcccctccggcctgtattgtcaggttcccacgtcgcagtgtatatcttgggggcagtttatcccccctcacactttgaggacttacagttttctgcctgactcattgtgtaggctgcagcctgccacttctttcaaagagtttgtggtttctttcagttttcctgttaagttcttgcctgcttactagaaaaaaattcacactgtgtatgtctagacactattttgtctttccaagtaggagaggcatgctaacaatgcctctaatccaccatcttgggaaaaaaccttttaattgtgggatttaatatgtttactttcaaggctgttattgataactacttcttattattttgttaattgccttttaattgttttgtatatccttgttcctttcttattctcttattgcttatctttgcaatttgatggctttctatagtgatgacatttgattcctctctttttctcatttgtgtatctgcttcttccagtgagtttcatacttttgtgtgttttcgtgatgggagatatcatcctttcacttctagatgcaggaagtgcatttaagcatttctcaaaggcctgtctagtgataatgaatttgctcagattttgtttttctgggaaagactttattcctctttcatttctgaaggataactttgctaggtatcgtatttttgcctgacagttttttctttttctttcagggctttgaatatattatcccattctctcttggcctagaggtttttgctgagaaatatgctgttaatctgatggagattcatgtgacttgatgctttcctcttgacatttttacaattctttctttgtctttgacttttgacaatttgagtataatgtgcctccgagaagacattttgggttgtgtctatttgggattctttgatcttcccgcatatgaatgtcttcatctcttcgaagacatgagaacttttcagctattatctttaaatcggttttctatgccttttgccatgtttgtaccttctggaactcccaacatttgaggttttgttcacttgattgtgtcccatatgtcatataggatttcttcactctttgattttttttctgagttatttcattttttttcttgaaagattaactgtttaactataaagaaataactaaaaattaaaaatagcttataaactttatttatataattactgaagggaacagagtaactgtttgtggtggtggacccaggaaggcggctctcaagttctggggagtgcgtatttccattctctatgttctcagcacagactgtctgatgtgcaggaatgcctgcttccaggtttagagtgctccatgggttcagatttactgcacatctcggtccagctaatgctctgatgctgcagacttctgggtggatatgagaggatgctagtgggaccccagggatgtggagatgcaggggctattaagccatggtgcagaatgttgtcttgtattgggtctgttctcaaaatgatgtcatgctgcagttgattgggtcctggggatgtaatattgcatgaactccttccgtggaacagtgcagtcacatggaccccaggcaaatccctatactactcagggcctttgagggctgaggggctttcctgtagcatgtactacaggactctggcatgtggactgctgaggatctcttacttgccttttcctccgatgggagtccctcctggctctgcgctaatctgactggatgcctcacttccccctctgtgctgccatctcaagctttcatgcctcagagtgtttcagttgcttcccttctggattccagcatttcttccctacacgctatattcaatgtgtgattacctacatgctgttttggttcttccttgtggaggaggtgagtgctgggtgcctgtaggcagccatcttggtctttcctcagcttttacttgtttcaatttctccttcatttccaaaagacaattttccttgtacattattcttggtaggtagtttttgttgttgtttgtttgcttgcttcagcactttgactgtatcatcccacattctctgttgagaaatctgctaatgggtccaagcctcattcaaaccaccatatgtgttatttagttattttatcttagtttcaggattccctctttgttcttcacttattacagttgggttataataagtcttgctatatttctggtctggattgaaacttattgcagacctttgatattcttgtatctggatatctatagcttttattgtatttggaaagttttctgctgttatttctttactccttctatccctttatctttctctgctcctcacaaactcctataattcaaacatttgctcttctgataccattccataggtcttataaactttctccattccttttgtactattttcctcctctgactgtatattttcaaataaactgtcttagagttcacatattctttcttctgtttgatcaattctgctattgatactctttaaatttcattaattgtatttttcaactccagaatatctgtttgattttataaataatttaaatatctgttaaatttcttattttggtcatttattatttttatgatttcattgaatcgtttctactttcttgaagttcactgagcttccttaaaactattattttaaatattttgtcaggcagtttgtatatcctcatttttttggagtttggcactgggagtttattgtgttcctttagtggtattatatctctttagtttttcctgtttctttttgctttatgttgatgtctgcacatttgacaaagtaaagattattccagtctttgcagactggatttgtctgggaaacattttcaccagtcatctcatctagagattttagcaagggtctctgtgatggtctgaggtcagcgttgctacaagagtcctttggcaggccagcctggtgcctgagtcagcaggtgggaagaactgacttctaggtctgtgggtttggcctgaaaccttgatccccttaggtagacctattgattgagtctgtggggatggtcctagaggctgtgtctatgagggtgagcctgtatctgctggagctgcctaaggtctagatccacagggatgacccggtgctggtgtgggccttgagcctgagtctgcaggggctggataggcacaacgatggctctggcatctggatccactggaatgggcctggaacctgagcccaaaaggactggccttgttctggggctgacctggcaactgagaccagtaaaatgtccttgaagttggaatccatggtggctggcccaaagcctttgtcttcaggagtggacttagaacttcaattcatagaatccttcctggcactggagtctaatgtccctgcaccttgagtctgctggagcagactctgggtcatggagcagctgagactggtctagagcctgagaacatcctagtactgaggatggcatggagcctgaatctgcaggaactggcctggggcctaggattgtcagtgctggccttgtcactgaagccacagtagctgtcctggagcctgtgtccactggtgttggtcttcaggctaaatgtatccgtgctaagctagtggctaggtttgagatggctggcttgggtcctgaggcttcaggggctaacctgggactggatacacagggtcaggccactattcctgaagaataaatatgcaaaactcctcaacaaaatattagcaaactgaatttaacaaaactaaaaagatcatgcactgtaatcaagtgagatttatcctaggcatgcaagaatggttcaacatatgtaaatcaataaatgtgacacatcacattaacaaaacgaaggacaaacaccatatgatcatctcaatggatgcaggaaatgcactttacaaaattcaacactttcttccaccataaaaactttcaacaaattaggtatggaagaaatgtaccttatcacaatgaagaccgtatataacaagcccacatctaacaacatactcagtggtgaaaagttgaaagcttttcctcaataatcaaggacaagacaagaatacccactctttccacttcttttcaacatagtactagatgttctagccagagaaattaggcaagaataagaaataaagggcatcttaattggaaaggaaggaatgcaattatctgtttgctaacaacatgatagtgtatatagaaatacctaaacgctccaccaaaacctgttataactgataaactaattcagcaaagttgtaggaaacaaaatcatattgtaaaaatcagtagtgttcctgtacactaacaaactatccaaaaaggaaattaatatataatcccatttatgatagctacaaaaaataatacttaggagtgaatttatttaagatgaaagatctatatgcagaaaactacaagacattgataaagaaattggtaaaaacacaaacagaaagttattccatgttcataattcagaagatgtaatattaaaatgtccatactatccttaaacaatgtacaaattcaatagaatccctgtcaaaattttaataatacttttcacgtaattagaaaaaaaatcttaaaatttacatggaaccacaaaacaccccaaatagccaaagcaatcttgaccaaaaccaacaaagctagagacatcacattacctgacttaaatatacactacaaagctatagtaatcaaaacatcatgtttctggcataaaaacagacatgtcaaccaaagaagcaggatatagagtccagtgaacatccatgaatttataaacaattgattaatcaagatgtatacaacacacaatggggaaagaacagtctcctcaatgaatggtcttggaaaacctggatacccacacgcagaagaaagaatttaagaacttacctcacaccatgtataaaaataaactcaaaataaagacttaaatataaggcctgaaactgtaaaagtgctagaaaaaaagaaggtaaaagctccacgacatagacctgagtaattattttttgagtatcaccccgaaggcacaggcaatgaaagcaaaaatacagatggaatagcattaaactaaaatgcttctcacagtgaagtaaacagttaacaaagtgaagagacaactgtagagtaagagtaatattttcaaagcatatatctgatgaggataatatccaaaatttataaggaacgtaaaaactcaatagttagaaaaataacacagttgtaaaacgggcaaagaacctgaggagacgtttctcaaaaaacatataaatgaccaatagtttcatttaaaaacattcaacatcactaatcatcagggaaataaaaattaaaaacacaagaagatattacctcatagctaatagaatggctatcatcaaaaagacaaaaactaacaagtgttgacaaaactatgaatcctgtacattaatggtgggaatgtaaattagtatagccattatctaaacccgtatggaagttcctcaaagactaaaaatagaaataccattattatctagcaatccccctactgggtaaatatcaaaagattgaaatcaatgtgctaaagaggtatatgctgtcccatgttcactgcagaattattaacaagaactaagatatggagtcaacctatgcatccatcagtggatgaatggaggaagaaaatgtggtatatatacacaatggaatactgttcaatttttttcaaatacaaagttatattcattttcagtaaatagcaaaacaaagtagagtcaggttgggcgtggtggctcacgcctgtaatcccagcactttgggaggccgaggggggtggattacctgaggtcaggaggtcaagaccagcctggccaacacggtgaaaccctgtctgtactaaaaagacaaaaattacctgggcgtggtggtatgcacctgtaatcccaggtacttgggaagctgaggcaggaggatcacttgaaactgggaggcggaggttgcagtgagtcgagatcgtgccactgcactccagcctgggcgacaaaagcaaaactccgtctcaaaaccgaaaaaaaaccaaaaaaccaaaaaccaaaaaaacgaagtggagtcaatgcactaatttttaaatctaacacaatgcttagaacaaactatgctcaataaataaaaacattattattaatggagtacgattattcttgagattctctatggttgtgtgtgtgttttaaacaaaactgagtcgtaggtaaagaaagacatcctacagacacgactgagaagggctcaaagaaaagaacagccaaggagtagtgtccccaaatactaagcaaaatgaatatgggatttttcaaagcagtctagaaatcagagctcactaggtttggagataatccatgttcaaggcctcataatgaaatctttccgtatttccagattcttgatatggaatctgtcacaattttaaggagcttctgccaaaggaaaggagatcgcttatgctgcctgaaatggcctacgcctcctaaatttcctttgactctgtcactaatatagcaagggttcattccagcaaaggattactactgaggaccaactcctctctggtttagattttgctttcataaacacattgacccttgccaaggagagctctatgtatatccaatttcttttctttttatccctgctacacaactctggctacaaaatctaggactctcacagcaatggcagcattggtcagaaggtaagtgccagttcgaacgcaagaactctctaaagttcaatggtcacaatttttttttaaccacttctgccacgacttttttttctctttaccttgccaattatttcttttaaaactcaatcctccaagctacattctgagcactaagttttttgaccaatgcatctctggtatcctcatcatctttttgcagatctatgtcaccttgttgggaccaaatggggtatctatcagctctctgaccagccgctaagaaggaggaagtagcctccaactcaccattattttttaagaaggcctgtgtaactgttggtagatccaagttaaatttttccattaactgccgaatgatcttaatggcaagctcccacccctggtggagaaagtccccctcctcctctgtctctctccctcctcctctatctctctccctcctcctctgtctctccccctcctcttctgtctctccccctcctcctcttccccattctcaccctcctgctgtccttctgtcttcctcaggcatgggtggattatcatcacacattgttatatgtatttcaaaatcagggctcttgatccacttgtaggaattgcctttccaggagtcctggacggttctcgcagttcagttttccatctttctgcgagatgctaacaaaaccatgcctctgatccaatgcctccatttagctgtaacaatacgttaatcagaactgcctggcatcctcctgaacaagactttcaatagggcccagtatgtttcgcttcatcctgaagttttctcaagcatctgctaagatgcttaagtactcttttgcagtgggactaggagccagcagaggaacagatacacgttctctcaagacgtctctccagcagaacttttcccctttgtttccgaggccttggattttcccaacatttccagtgtatatgaacaagacacaatgctatcatacatccccctgcaactttaaaaagcaggagtaagcagtacttccagccaggccaccaagcaccatcatgtacctgcctgacagcccaaagccagcattataggtaactctggcaggactaatccccttcattggtccaccactggtcctgctaatgacaaagacttatattcccctattagcctttactcagatggagccagtttcctatccttgtggtggtcagatggggttttgctgtatcagaaggcagtccagccaaacccgacttccttcatttagctaatagtacagttcctgttgttttcacggtttgccttatttctgaaagactcagcgaagccatagcaatcataggtaacggggatagcattacacatctgtttcttttgccacattatcccaactggttcaaagccctgaggaaagtagtcactttattggccactttttcatttataatcactttagtgttaaaaatatttacccacagaatggacctaagcgacctggtcaagtagaaaaggcatagaactacactgtagataacactggtacactggctacacctttttctacttctcctgtttgcctctcccctcccccacaccaatggtaatttattcttcacacattattcttcatttccagaaactgttacttcatagtaattacttaagcaggagcacgaaaatccctgacaagtcattttcatcttgtgtccagaattggtgggttcttggtctccctgacttcacgaatgaagccacagaccctcacggtgttacagttcttaaagatggtgtgtctggagtttgttccttctgatattcggacgtgtttggagtttcttccttctggtgggttcgtggtctctctggcttcaggagtgaagctgcagaccttagagatgagtatcacagctcacaaaggcactgcagacccaaacagtgggcagcagcataatttactgcaaagagctaaagaacaaagcttgcccagggcagaaggtgacccaaactggttgccggtgctggctctggcagccgcttttattcccttatctgaccccacccacatcctgctgattggtccattttacagagagctgattggtccattttgacagggtgctgactggtgcatttacaatccctgagctagacacaaagtgctgattggtgcatttacaatcctccagctagacataaaagttctccaagtccccaccagattagctagatagaatgctgattggtgcatctgcaaatccctagctagacacagagtgctgactggtgcatatacacttctccctctagacataaaagttctccaagtcctcacccgacccaggagcccagctggcttacccagtggatcccctgcaggggccacaagtggagctgcccgccagttctgcgcagcacgcctgcactcctcagcccttgggcacttgatgggaccggacgctgcagtcgtggagggtcgggcccgcaggagcccaccgtgcaggttgggggggcgggactcaggcatggcgggctgccggtcccgagccctgccccgccagaggcggctgaggcctggcaagaaatcgagcagggcgtgggtgggctggcagtgctgggggaccccacgcaccctccacagctgctggcctgggtcctgcgagcgccaccacagtcccggttcccacccatgcttctccctccacagctccccacaagcagagggatccggctccagcctcggccagcccagacaggggctcccacagtgcagcggcgggttgaagggctcctcaaggtggccagaatggaagcccaggaagcactgagagcgagcacgggtcaccagcacgttgtcacctctcagtctcatactaaatttgttttcactgagtcatgttatgaattatatagtcacccgcttaaacatttcaatgctttaactgtcttgaaaaatataaaataaaaaaattaaaaaaaaaaaatcagggctctcatccaactccctggtggcttccgcaggcatgttttttgatggctgcttcatgcttctgggtttcttccttcacatgttcttcaggcaaagctggaattctcttattccatggttcccggcaatcctcaggctccgggtcctgctctgccttctgcttgagcgtctgggagcgcagcgggggctcctggggcattccctgctcctggccccataggttctgaggggcctttcttccgcgagccggctttcctccatcgcttcccacaggctttgcccgcgaccgaacagggcgagcaggcattttccttcacgtaggcctgaaaagccacgtcacccgcatccctgaaggcggccccaccagcgactacggcttgggctccacggcgcgctctgccagggaccccccccccccaccgccggtgcccgagtgggccgcgtaggcggggcccagcccataggccgccagctccagccgctgcagcgttctacgcggtccgggacgcactgcgcagacaacaaagctgctggaggcgtccccaggctgggccagcggtgtggcctgggttcctgcaccgagtggtgcagcagctgcttggctgggctgggcagcaggtataaggacctagagttgccgtcctccctggtgaacagaatcgaggaatggttgggcccgttggggtctttgcccagatccaccgcctccaccatgtttgacgccgggcaccagaggagccgccccctcccgagcgccatggcacgcacagagcgactgactgagccactactgatttttaaaaagaaaatattcctcttatttgtgacaacatggatgaatctggagaacatcatgctaaacgaataagccaggcacagaaagacaaatactgcatgctcttaattatatgtggaatgcaaaaaagcttaactcagaagcagagtagaatggtgactaccagaggctgggggcaggggaggcaatagggagatgtttgccaaggagtacaaaacttttgttagataagagggatatgttaccatgcaaacggtaatcaaaagaaaataggagtggctatacatatatcagacaaagtaaactttaagtcaaaagttgtccctagagacaaagaaggttattacgtaatgataaaagggtgtattaaacaggaagatagaataattgtaaacgtatatgcaaccaactttacagcacctaaagttaacattgagagagaagaaaggagaaattgacagcagtagaacaataataggaaactttaacactccactttcagtattaaattgaatatccaggcagaaaatcaagaaatagtgaacttgaacaacaccgttagccaaatggacttaacagacatgtacagaacttttcacccaacagcagaagaatacacattctttttaagcttacaaggaacattctccaaaatacatcacatgtgaagccacaagacaagttttaacaaatttaaggagatcaaaattgtatgaagtatcttttctgaccacaatgaagtggaactagaaatcaataacgaagaaaggtggacaattcacaaatacatggaaactaacataatcttaaaaactactggatcaaaaagagaattttaaatacatcttgaactgaataaaactgaaaaaacatactaaaagttatgggatgcaataaaagcagtagtatgaagaaagtttgtagtgataaatgcctaaatttaagaagtggaaagatatcaaataaacaacctaactgtacacatcaaggaactagaaaaagaagaagcagctaagccaaagctggcaaaaggaagaaaataatagggattagaatagaaaaaagtcaaacggaaagtagaaaaactatagaaaaataccaaaaataaaaattgccttttagagaagaataaaattggcaaactcttagctatactaagaaaaaaagtaaagaaacaaaagcagaattaaagaggagacattacaacagatccctcgaaataaaaaggatcataagagactattatgaacaattatatgccaacaaattggataacatagaggaaatgggtaaattcctagaaacatacaacctactaaggctgaaccaagaataaatggaaagccggaacataccaattacaaagatattaaagtagtaataaaatgcctcccagcaaagaaaaatccaagaccaattggcttcacaactgaattctaccaaacattcaaagaagaaataacaccaatccttcttaaacttttccaaaaaataaaaatagaggaaacacttctaaccgctttatgagtccagcagtactctaataccaaaaccaaacacaccacaagtaaaaaaaactacagaccaatatctctgattaacatacatgcaaaacatctttgataaattgctagcaaaccaaattcaacaacacatcaaaaagtttatacaccatgaccaagtgagatttatcattgggatacaaggttggtttagtacatgcaaaacaatcaatatgataaaccacattaagagaatgaaagattaaaaccacataatcatctctatagatgcaataagcacatttgatgaagtttaatatcctttcatggttaaaaaatccaaggaaaatagatatagaagatgctgtggtatgaatgtttgtgtctctaaagttcatatgttgaaacctaaaccccaaagcaatagtattaagaggtgtgggctttaggagatgattaagtcaggagggtttctccctcaaaaatgggattagtgcctttataaaagaggcctaaaagagttgttcatccttctaccatgtaaaaataagaagatgccatcttgaaacagagaacaagctctcaccagacactgaatcagctaatgccttgatcttggacttatcggcctccagaactgtgagcaataaatttttcgtgtttataatttcttattttaagagattttgctattgcagcccaaacagataaagatggcaggaaatttcctcaacataataaaggccatttatgacaagtccacaaagaatatcattatcaatgagggaaactgaagcttctgctaaggtctggtaaaagaaaaggatgttccttcttgccacttctatttaacacagtactgaaagtactagcaagagtaatcagacaagaaaaagaaagagaagccatacgaatcagaaaggaagaagtaaaagtgtctctgtttgcatataatatgatcctttacttagaaaactgtaaatattccaccaaaaaaacttattagcaataataaataaattcagtaaagttacaagacgtgaaatcaacataaaaatcagctggttctatacactaacaaagaaatatctacaaaggaagtcaagaaaacaataccatttacaaaagctacaaaacgataggaataaatctaacaagggaaataaaagatctgaaccacctttccaaagaaaaatttttttttagagatggggtcttgctatgtttcccagactggtctcaaactcctgtcctctagtggcctcccaaattgttgggattacaggtgtgaatcaccatgcctggttcaggtaaaagatctgtatactgaaaactataaaacattgatgaaagaaattaaagagaacattaataaacagaaagaagaccccatctctacaaaaacaaaaaaaatcctaaaatattagtcaggcattgcggcacatgcctgtagttccagctaatggggaggctgaggagggaggatcacttgagcccaggaatttgagggttccgtgagctatgatcacaccactgcactccagcgtgggtgacagagtgagaccttctctcaataaataagtaaataaataaataaatagaaagatatcctgtgttttggtttggaagaattaatactgctaaaatttctatatatcctaaatgatcgataggtttaacactacatagaaattttaatggcattttccacagaaacaaaaaatactaaaatttgtataaacccacaaaaagttttaaatatcaaaataatattgagacagaaaaataaggttggagcatcatacttcctgacttcaaaatgtattgcaaagctacagaaatcaaacagaatgctcctggcataaaagccaacacatagaccaatggaacaaaataagaaactcataaataaacccaagcacatatggccaattaattgtcaacaagttcaccaggaagacaaaatgggaaattgatagtctcttcaataactgatgtgggtaaaaccggacatctgcccgcaaaagaaatctgacccctatcttacaccacacacaaaaacaaactcaaaatggactaaaagcttaaaaaataatacctcaaaacatttaaattctaaaaaaaatacaggaaaacttcttgacattagtctgaaaaggattttttaaaaaataattcaccaaaagcacaagcaataaaagccaaaataagtaaggggcattacatcaaactaaaaagcttctgcgtgccaaaggaaacaatcaacaaaatgaataggcagccaatcaattgggagaaaatatttgcaagctatatatcttataagactttagtactcaagatacataaggaactaacactcaactcaatagcaatgaaacaaataatccagtttttaaaacgggcaaaggtcctgaatagacacatctaaaaagaagacatacaaatgactaacaggaatataaaaatgtccaacatcattaatcatcagggaaatgacaatcgaaaccatgagataccatctcacaactgttaggatagccattatcaaagagacaagatataacaggtgttggtgagggtgtatagtaaagaaaacccattgacactgttggaaatgtagattgttgcagtcatattggaaaacaatgtggagtttcctctagaaattttaaaaaatagaactaatatatgacccagtaatccctcttctggctatatactcaaaggaagtgaaatcaccaccttgtaaacatatatgtgcttccatgttcattgaagcatggtttacaatagccaagatatggaaacaaacaaattgtggtggggagtgtcatcaagatggcaaaactggagatactagcctttatccacccccaaagaaaataaatagctatccacaaatgaaaatatctctaagagggctcaaaggcacattaaagaatgtgaggcaacacagtggagcaaaaacaataacaacaacaaaatacaataaaaaaggaggctatccacagaaaagaacactggtgagactggcatatctgagactccaggagatggctagggtcaaagaagaaaggtgaaagctactgatatcagccgcatggcaggaaccaccatggtccccaggggccttcttcaaacaagacactggcatgttttgtcactgagttaagaaacagatatttctgttgggggaaccccatagaggaaggcacagcttcacaaccctcccttacccaagaagctgctgctgttgagccactttgggaaatcacctgcctcctctctcaacctcatgcatgccataacccccaagcctcagctgctccatggatgcccacgcttcagagactggagccatcaccataccaagctggtgtacactccaggccctggagccaaggtctctctaagtgttccctgaatccaggcacaagctgagccgtcatagagaggcaggccctgacctgatcctgaaacactgtaactctgaacacacctgtggcaggaactggggagatgtatattaaaggatacgaagtctcagtgatacagacgcatgcatccagagatctgaagtacaacatgagggctatagtcaatgatattgtagtgtatactgcaaattttctaagaggatagattttaggggctcttaaccacatgcacacaaaatgatagatgttaatttgcttgactgtagtaatcatttctctatgaacatgtatcaaaacattatcttgtgtaccttaaatacacataataaaaaagataaggcgaatgtgaaaactcagcggagaccttctatgagtgcccctccaccttccttgtgtttcctcctgactctctcttgcatggaacttctattgcatgcagagaattcattttgctgttttcaaatatatgctattgtgctattctttaagactactacccataataacactgagctttaaaaatcattccctacttatagctttttagcctataagcttagcttactagtgtaagaaagaaagagaaaagaaacaccaaaagtggcttaacaattaaagacaggtttattttggagaataaacttgagaggggcttctggccaagttaggttagaggcattttttcttacacactaagagtttttaagggtttgatgtgggacagcttattataggcttggaatgtttcttgtgtttctttgtctcgcttatctgggagggagagtttgtgtgcatttccatccattttcctgaagctgcaggtataccccgagtctacttttagcttccctatcttagtgcacgtaaagggaaaggaatgtgcttactagggcccactgtttcactggggcccattgtatgagggtgaagtttggctgttacccaagagactttcccccctccctctgtgcccaaggtgtcttatctgtgttttactgtctgctccttccggctgcttgtagttagaagagaagtgacttccttgaaatgcaggaggctagaaaaggggctggaaattaaagtggcgatgtttgactgacatgacggtgctcctgccctgtcattctagaccctatagttataaaaggatgaggggcaatatttttgtttgtttgtttgttttgctacttcctgctggggggggggtggcagacagatttctggttttggattggctgaaggagcaatgccatttgtagatgttttgggtagttgtttgtgaaatagccatgattctattggttaagaatttttgaaaaagctgaattaggtagggtaaaaacatgagtcctgggctttttagcagcattttttattaggcctgattggttgagatagaagcaacttttttttttttccaatgagaggtagaggcacatgtttggaaaggcctatgtgttattttttgttagtaactgttattcctactatgaggatcataattaagcaaaatgctacagtaattgagattctctgtccgatattttaccctgagggtgctaccgtatatagttttcctgcaaatagtaaagtgagtaaagcaattcctgcaagggtggcatagtaaataatttccattaaaaacgttttaatatttggcttaaaacgagaagtagaaatgacaaaaagtatttggtgagatagaggtgagactgagtaagatgagtaatttttacttacgaacttattttttgtgcttttagcttaagattatttatgttttgtacattgatatttgggacatttctctgggctgttaggagttgcttcctcagatttttaagctttgacttgagtgtgatgtatttaggagttgatttctgtaatggatataagttaaactgtagcaaatagtaaaaactgaaaaatattaggcaagactagaatttaacaacaggtgtgctatagtgtttgaaacataattttctctgttccgttttccatgtttattaaaagacaagtcatggtaggactgatttgctttattatacttggcttaattatttgcatacaattcagcaagaataactatttgctacataggccttttaaattggctttgatggcactttgtttcatagaaggaatttgagataagactttttgaagccaagcccagccatggatttgtactattaaacacctatgagttggcagaattcctttcctcttcaggttttaagataacttggggttcctggcctgcgagaaactgacattctttacttaccacaggtcagaaaccctgtacaggggctgtgtacacagaatctgaggccagtgtccaagggctatattggctccataagtcaagtttgattccttaaaggagagcacaccattccagtcaaagccttggcaaaataaccagtttctccaattgtgttctgttacaaaagaaaacaggttctttttttttttttttttttttttttgagacacagttttgctcttgttgcccaggctggagtgcaatggcgcaatctcggctcactgcaatctccgcctcccaggttcaagcaattctcctgcctcagcctccccagtagctgggattacaggcatgtgccaccatgcccagcaaagtttgtattttgtatttttactagagacagggtttctccatgttggtcaggctggtctcaaactcccgacctcaggtgatccacccgcctcagcctcccaaagtgctgggactacaggcgtgagccacctcacccggccagaaaacagatttttttttttttcagatggagtcttgctctgccacccaggctggagtgcagtgttgcgatctcagcttactgcaagcttcgcctcccaggttcacaccattctcctgcctcagcctcctgagtagctgggactacaggcgcctgacaccacacctagctaattttttgtatttttagtagagatggggtttcaccgtgttagccaggacggtctcgatctcctgacctcgtgatccgcccgccttggcctcccaaagtcctgggattagaggcgtgagccaccgtgaccggcccagaaaacagtttcttatcgcacttatgcaaacaactatattggtgtaatttaagaatacttataactagtttttaaattctagaggacctaggcagagagaaacacgctttaaatcctatttacaggaatatactttacttagctgtgaaagtctgtcactagcttaagacaagttttcttgactctgaaaaaataaaataaggattagcagtgttttaagcaaaaggtaaaaacttgttttggttttctattagtttagtccattttcttaaattttgcttgatatttataaacattttagctttccatgaattttgtacattttttgttgttgttgtgagaaactcatgtttgagagcacttgttaaagtcccgcagcttgattataaaccatcttttgaaaagaattaaaacgaaacaacaattgtgtgcaaatgacaaaatgtccagtttggatacagttagaaacacaattaacaaagaaatttagtcatttttgtggtttacaataacccaacataacaaccttaattgtgattgatagcacatattcagacactaacattagacatttcatacagttttggaacatatgttaatattattccctaaaatataacttattaggcagtgttttggcaattttatgtacctaaacatgttaaataatcctgtttacctttgttccagatgctttaggggccctttgcaggacctaaaatttaggggttaggaaagacaattttgagactaaagtttggttttggaagcctgttaaatatgtttaaaatttaaaccatttgatattatgaaatggaattttagattattatttttgttcatttgtgtgtttgttttgtttcgttttgccaaaatgatgagttaaaaatttggaaaagcaaaaaccatttattagccttttttattacatgaaaattctgtttaagagagaaagttacattttaccctttcattagtttattaatgttaaccctaattttaatgaaaccttatagacaattctatttaatcttaaccagtttgactatgaagtgagatttttacatacctgttataatccttgacacattttgctaaagagtagattagcattttaagaaaaccttgtggtgcttttattttagtgtttaatttacagaaaaaaaagttatacccttttgagtttagttaatatacttacacacagagttttctttgcagaattaatttttataatgtttttacaatttgcttaatccattaatttaattttaagataacttatttttaagcaaaatgtacatttttgtaccttcttttaatttttgactgaaacactttttactgtttttatgcaccttgcatgtaaattcatgtttagtagttttcactacatgtcataatggtaacttttagcaatttttaactttaatgtaaaacctgttaagttttttaaattatgtgccagatgcagatgaagtctgactttttccagcatagttaggggcatggttactttgatatgtttctggccttatcaattgtgaagcaggtaagttgacagtttttaaaggataaagaagcagtttacaaccttaaaacagcaaacctagtatctgacctgcctaacatatgccgcatttttacaccttgaagacattggtattttaccaataattcctaagactgtttttatttttaaatattaaagttacgtgaactgaaaggtatcacaacttttacttttcccttaaaaatatttgatttaagcacttatttttcttaggcaattaattagccctctttttaatagacatggcacacataacacgtgcatagccacacagacaaccagaagaagaaccagtcgttgtaagatttttcattttttgctaatttccctgttggattattggccttcaggtgaggccctttaagaacagtgctaggaataccgtttccagggcctaataaacaagcagagccagaagacaaagacagactttgagaggtacttattcacctctacttccaggggttccatgaggaaaacagagatttttcccaaaatgggatttgtggtgccttttctgttttcccaaggagtcccaggccaccagaagttattttggggtcttttacatatgcaccaagagtggtaagacagagtggagagaagtaatttaggtgaccgagaaaaacaccttttctaggaaaacaagatttatgaagagaaaaacataaaggccttttgagtatacttatagcttggatatttaattttaattaagctgagcgttctttctactaggggtgagggtggaggttagaattatagaaatgttatgccaagttaaattacgtgcaggaattccctgtgataatgagagggattttttgggaaacatcccagacactgttcgatttgcaacaaatcagacccggagaaggggacgtgaacatgagtgattccttcaagcccagccactgctgggagagggaggatggcggaggaggtttcactggttggagcaggttttgaaccggtggagaaggaggagggcggggcttaagggagaagaaagcctgaatatagggaaccttttgccagttaccgtctctggtgataaaggcgtcaaggttcctgagaacctgaagggtaaaggtgctgctttgggccgctggctgtcattatctagtttgtactggggccaggacgtttgcaagataacattaaacgctttggctttagactcccgactaagccaagtttgacgaggctgtgaagacgacagttcagtggggaggacgcaggaatgtgggggtgctgggcacccgcgagggctggtaagaggaagccaggggtgtctgtctggttctgggccttcccagacaaaagccagagacccggagcctctttctgagaaggaaccgggcgtccccaagatttcctctagccgagtcccctgggtcccccgaggaccgggacagctctggtacccggagaaagccaggagaaggcagattttacacctcagctgaattagtgtccagcattgggtgttgcagttggaatcggcaaagggcctcagactggagctgcgggaggaagagagggagacgaagagggagagaagaggagggaagagagcaatggtcggagagcaaaataccagttgtgagcggttggagggggagtccaagacctgagggttttgagagcccacaggggaggagccccggccagagtctcacagttcccttcaatgcgaattgctcggaaagtgaagggagaggctgggagagccgggcccggcggcgggcaggcctaaggcggcgcgggacacccactagtcgcaccttttcccggctctcgcctctgcagagggagcaactatggctgcggaagtcctggaggcagcctccgcggaggagcagaaggaaaaggaagataaagtgactagtccagagaaagctgaagaagcaaaattaaaagcaaggtatcctcatctgggacaaaagcctggaggttcagatttcttaaggaaacgattgcagaaagggcaaaaatattttgattctgggcattacaacagggctaaagcaaaaacgaagagcaagcaacttcctactgcagctccagataagacggaggtcactggtgaccacattcctactccacaggaccttcctcaacggaaaccatcccttgttgctaacaagctggctggctgattaaaagagctgaactgcatgaagctgctaattcccattatttctctttaatatgttacttacctttttatttcctttcattcactaagtcatttgagaccgacagctttgcaggtatcagtaatgtgtgctgctattgtggaatatacaggtgtagagtttttgattagtttaacagtgcactggggaagaggacatgtcagagcaacacaagtaaactacttgaaaataactgtatgtattacctaactcctagtgtagtactggttctaacaagtaacaagcaagttttaaaattttaatgttttgactttcattacttcatcttaattacagctttgtatgttactcttatttaatataatctctattgtattgatttcttctgtataaaccttttggattttgtaaaacagaggtttaagaccacaagttagaagaaaggtcacctatttcaaacaactagatggggctccacaagatttgtatctctgtgcttgaacttgaatggccttaaacctgtttcagctttaacagtagaattttacttgggcaatatttgcccattctggtgtaacttatgtgaccctagtgcttaacagctgccgtcgaagctaatattcttattcagttctgtagagtcagaataccttttgttgttgaagatgtgcaatgactgttgaattcacttttgtgccatttttgtaaatacaataattttgcacaacctctcacaaatgcctatatttatttcacatacttaaaaagtagataatgtgccaagcagaagcacaagaggtcctacacaaaactctgtaagtcattatagcttttgtataataagagtagtttacaatctcgggcttatagaataccaaactgaaatcttagttcaatctgtcatagacttaagcttttcatttgttactaatatccatggcattcagtggccttgtgcaaatacgatatgttgcttaggaatatcttttgtcctatgcagaacctttcattttgatttttatgaaagttgcaattcatataatttatataaactttttaaatgtagaaactttttacttccacactcaactttggagacactagagtaaaaggcttcaatactctgcattctatgccccctgccacctgctttttcccttttgttcttcgactcaaatggtattgggttgtttgttctatacgaaagcataggtgtctatatccttactcttttaaataacacaataatgatgttttccttctaatttctcagttgttaatctctctctctctctctttttttcttgagatagggtctttctctgtcacctaagctctagggcagtagtgcaatcatagctcactgcaaccttactcctaggctcaagctaactattcttaatcctttattattaccaatattctacaattgtttaaataaaaggaactttataatcaaacagtacagaatactggctcaagaacctatgtcaagatgagctgaattttggtacattattttaggaattatgacaagctaatagaattgggcttgtgacaatgagagtaattcacatgacaggtaaaacttactcatattaaaaatgtttagatatttgcttctatagatgtcactttaataaaataacaatttagttttacttgtggcttacctagttagcaagaactttaacagactttattgggacaagcttactgctcttgtaggagctcctctcacaagtagttgtaatgctgtaccatgatactcaggatcagtaacttcagatgttactatctttctcttcatctttgacttgcagagagcctcctctttttggatccaggcatcttttctgaatcctggttccattagtatacctgctctcctatgatcccaaatcatagtcaatggtgcctccaacatagcaccttcagttaaaggctgcctagtgctctgaggaaagcttactgattatcttcctgctctactcaccccgaaaggcagaaaagcaacatagtcactcctgtgctcatttgtaattgtaaagatcagagatatagatatttgtaatgagagcaagtatatactcattataggatcaatttaagaagtttaaaatatcccaaagtagaatttctatatctagtcttctgggtttttttcacgaatatttgcaagtgattacgcttaacttcacacatgaaagattaatctgaaaggtcagagagaccctgttattcctgaccacgatagaactgctcctgtggtttgggacaagtaacaaaacaactgcttgagttttgtttgtaaaatacactattaatatttgacctacctcaaaacgtattgaggatctgtgaaacactaagtgcccaaaataaaatattgctgattgtctttttattaaaagtaaatttcctcattaagccaaccggccttctgtaagtcacagtgctcaagtctcagggtttgtcattaggagaggtctgtcgttaaggatttgtaggtgtaattgcctagcctccattattggtgattgcgatagagaggttttacatttttctgtttttcatcctgccccaaagctcagtttattgaagacatttgtaagctattggatcatcacttgaatcaagattttgactagtgagcccaattgtccctttcttattatttcaaagctatagtctgagaaatggctaattttaataactgtcctatcataaattaatgttggaataaactgaagttggagatgaagacttcatgaaaactaactaaagtctgaaataaatcacctgttttatgtccaatagctactgcctttgatagaacagttttgaggaacatttcattcttgaaggcagcatccgacatggttctcagcaaattggaatagtaaggattgttgggttgtttcgatgagtggaagcagcgtttgtagcataaaagttattcaataatcttgtgctgttgacctgaaaatgtgtcttaactattcatcaaggcaagcctggtgaagcctttacttgttactacttcaacagttggaattagttgctctttttacttgatgaagcaaaactatacctctgaatatttatggatgctttttacaaaatcaggcttgtgttcttaatccgaattagtaaagttttatggaagctgaaatgtaatacagtagtctccccttatctgcaagagatacagtccgagacccctagtagatgcctgaaacctcagatagtactaaaccctgtatagtctatgttttttcaatctgacaaccaaggcggctactaagcgactaaggggcaggttgtatacaacctgtgtggataagcaggacaaagggatgattcacatcccaggcaggacagaggaggaggatcatgagatttcatcactacatggcttgtgatttattttattattattttttttttttgagagggagtctcgctctatcacccagcctggagtagtggtgcgaccttggctcactgcagcctctgcctcctgggttcaagcagttcttctgcctcagcctcccaggtagctgggaatgcaggcgcccgccaacatgcccagctaatttttgtatttttagtagagacagggtctcaccatgttggccaggctggtctcgagctcatgaccttaggtgatccgccctcctcggcctcccaaggtgctgagattacaggaatgagccacagtgcacaaccagcttgtgatttaaaacatggtttatttctggaattttccacataatatgtttggaccaaggttgcctcgggtaacaaactatggaaagtgaaattgcagataaagggagttactgctgctgtgctctaaaattggtgtttgggtgatcaggagtgggtagccaatgggaagaggtgatcaggagcaggtagccaatgggaagaggtgatcaggagcgggtagccaatgggaagaggtgatcaggagcgggtagccaatgggaagagcacttctgagtgatcaccaaagcagtttctttagtggtcttttcacattctccaatgttcaagcatattttccactttccattttctatttcacctcattttgcctcatcatctgccatccctgcttatttcttaagcctactgatggcactcactaaattgtgtttagggctaatgaatcattgttccttaatatccttttcaatatgccacaatttagaatgcatttaaaattttctaaaacaatatcctactctgaatattaactaatttgagccacattcccatctctaactcagcacaaagtgccagtcttccccaatatctcctctcaactccccaccgcaccttataaaattggaatcagaaatctcactctgtcattgctcatcttagaataaaaacactgattttaatactgttttactagtttcagccttctaagtacgtaggcctctaggtattctgcagatcactggtggtcttgatagccattcatatatgttcgtattatgttatttttcaactaaatcgcaattggaaaaaaacatctttaatattatgcccttggatctgttacttcattactaatacttgtgatgcaataggacacttcacctgtactaaaagggccaagagtaaatgtcttgttttgttgttgttgttaaacatgtctacagagttggcagttaatgctgaatttgtcaaatagctcttccaaaattatacttgtatttaaaaaataaatggatctacctaatttctattcatctaatttgcagttttgtcttattaaagtggtatgtttttcaatgtatttttttctgaagttgatctctttacatttcagctattactgtaggcagaaagaaattgacttgtaatctttgatttttttgcatttgtaatggctttgtacttaaggtaggattacatgtttacagattgtgggggaaaaaaaaagaaaagtgaagggagagaaaagacaaggcgagtggccagagaccctcaggatccaagagttaactctgattaactcagatgctttgttcagccaatttcagacttcttttttcctaatacaagcacttaaggataagcctttctgtaagaactgccttacatgcatcatagtattttaaatgtagtgttttcattcttcttctagtctaattaccttcaacttctattattagttctcttagacccattagttatttaaaattgtgttattaacaatttctaagttcatggggtttcctctttttaaattgctctttaccttcgttgtccttcgtggtgctctccgtggaaacctgctttctgatctagtaagtgcttattctttgtgcatgtccctagacttgaaatcactgcataatccctaactgtgtgtgtcctggcttagtgcatctaatgaatgactgaatgaatgcatctttgcctttgccttacccccgggcctgaaacatcgtcttggtccccttctcaataccttggatccttggagatcaaggtcctggttgttctggcaagttcaacacaatctggcctcatgatcagagtcctgtccctgaactcaagacaagggagggatgggcagaattacctcatgctgtgccaggaaatatgagtctcatggggcatggcctgtgtgcctgggcaaattcactgcctcactaccctgtgctgagatgatctctttttttttttttttttttttttttttctgagatagagcctcactctgtcaccagactggagtgtagtagtgcaatctgggctcactgcaacctccctcttcccggttcaagcaattctcctgcctcagccgcccaagtaggtgggactacaggtgcgcaccaccatgcctggctgatttttgtattttcagtagagacggggtttcatcatgttggccaggatgatctcgatctcttgacctcgtgattcacctgccttggcttcccaaagtgctgggattacaggcatgagccactgcgcccgtccaatctctctttcagggacagatgttcactctctcttgcagctctgcctgccagactaagcctgaaaatatctctgcatctggcattcctttaccacctatgtggggcacaacccagaacaaagtccctccaagtgtaccctactctctttccattatcatttctctggtctgagatagatgtttatgacctgccaataaatgcagtgactcaaactccagtgcccatactcctcattcatacagccatgtttagggaggctctagggagaaatgcacagtttgacatcgttcatgaagagcctctccacggctcctgcgcctgagacagctggcctgacctccaaatcatccatccacccctgctgtcatctgttttcatagtgtgagatcaacccacaggaatatccatggcttttgtgctcattttggttctcagtttctacgagctggtgtcaggtaagcctttcagtttggactgttgtttttctccttgttgaataatattttgagttcattcatgacaatgatctcagcacagtgagatgcaggaatctttggtgcttgcattctccagcttctcctggcctcaggctggaaactaccaatgccaggagctgtgggaagcacagggcagcaggaattgaggaagactccttgggctgtttctcaaggacttgggcactatcacagtagctcagaataatgggagcaggccctgggagcagggagggaacacattgagaacgccaaggtaaacacattgttctccccaggtgggctgtggggcttaggcaggggaagtctctaataaaatccccaggtttttgacttgggtgcctgggtggaaggtggcactgtttaggatgtttggagaaaaagacaatgtgtccagttatgcacatgctgagttagaaacacctgtagttatggggtagagcaccagacctttaagtgaggagtaagttggaacctggcatagtctaggcagaaacccactcttctttctccttctagtaaccatcaagacaaagcctggtgtataggatattcagtaatcaaataaattttgcagggagagataggggctggagtagaacactggattctgggtggtcagtgttaagccacaaaaagttcatttgactgtgttcactttctgtctggaacagttccatcctgctatttgtctacctatgactgttttgctaaacaaagccaacaaaacagaaataaggggatcaaaatccatgtgtgctcagagggcgtggtggctcacacctgtaatcccagcactttgggaggctgaggtgggtggatcacctgaggtcaggagtttgagactagcctggccaacatggtgaaaccccatctctactaaaaacacaaaaattagccgggcatggtggtgagcgcctgtagtcccagctactcgggaggctgaggcacgagaatcacttaaacccaggaggcggaggttgcagtgtgccaagatcgtgccactgcactccaacctgggtgacagagtgagactttgtctcaaaaaaacaaaaacaaaaaatcacaatccacgtatgttactcacaagacagcctccgtttaagtacattctcacccattttctgacaagcctttctgtctgctttctgtttctgcatgaggcagcagggcatgctggaaatgaccttagaggaagtaacactatttttaaaactttccttttctctatgagcttgtggctaataacttctattagcatcaatttttgcttatgatgacatagagataataagatcacatctgtgacattcctgtggctgaagggctgctgtgtggattgcgtgaactcgtgcatgtagagcgtccagcacggagctccgctggggcacagtatgttgcgacaacagacagtgtcattccttgcttctccccaggggaaggagtaaagggagacgctgtcggcaagacaaatgacagcagcaaggctggccggagaaacagacatatactaaaaactgtttgcctggcttgagagtctcacacagccttgaaggcagcactcacagcagcccagctgacaggctgggtcccaaaagctgatctagagcaagggcctttctgcaggtggtttgtttagcagactgttctcagaaacaaaagtgacagggtgcagagagtgaagccagcgggaggtaagccatagagggtgcgctaatgagcaggttgctgcggtggcaactgggacccagtcccactgggtcctttggaggaactgtatagacgatggctcaggatcttcccaacatccactgcttcctgttccccactgggtgagatgtgcccctccgggactattaaaatcgcaaaccttcttggccaccctgtgcctgggctgaggaggttccaaaggttgcaagaagccatcagcagagaggcagaggccaggctccaggggcggagctgtcagcaggcaggcaagtgcccatcccattccagggggactcagggttgggtggtgaggagcagggcctcaacatctgctacaccaggtcagcagctggtctgacaccaggctgcaaagtcacgcctcacttaataatgctcttaaagatgcatgagtgaaatacatttcagcaagatttataaaatgtacttaaacttagaaataattagtgctaaaattaaaaatatccacttatctggaaattcacacatgggatccactttgcctctgatgcacatgcagataccacacacagatatatccatataccataaatggatacatgtgaatgaatcaagagacactgccaatcaaagggggtgggtacttagaaggtgaagggagtgggcctccatcgtttgtggtctctctaagaagaactctaatcatacagagttgtaagtgtgatttgcaccagaaaaattacttagttgaccacaaaaccaagaagcaaatgcaaaaagaaagtagcgctcaccattcctaggcataatccctgtctgtggagcccattctccatgctgggcatggggaatcctgtgctgagggaaacacacacactctgtcctcatgaagctaaaagtcgtgcagggaaggctcgcagaaaacaaacagttatgtcacttgcagcaagatgaagacagtttcaagtgaagatcaagacaaagctgtaccaagaaaatacaaacaaaacaaaacaggtaagccatgttgataaagcactagagtgggggtgtccaatcttttgccttccctgggccatattgaaagaagaactaacactaacgataactaatgaatgaaaaaaaatcacaaaaaatcttataatgttttaagaaagtttaagaatttgtgttggaccgtattcaaagccgtcctgagtctcatgcagcccacaggctgtggcttggacaaacttttgctagacgaagtactattcaagcacgaaataataaagtggaaaaacataaaattattacctggagtaaaatgtaggtgtcatggaaaagatatgtcacaacatcagtgcactaaagggcaaatctctgaaataaaaactacaaaatctcctcactgtgtcacaccatgtccttcagaatatggcagaagtctacttaaaaaaaagaagcacaaataaatgtgcttcagcggagaatatatattcctttcttgtatccataaaacatttacaagatgtaatcatctatttgaaggaaataaattttcccaaattcgatattttatggccacttactcccctcctgggtcattaaaaaaggtttttagcatagaagatgcaaagggggtggtgtgagtgttcattaagcagatgggcagagaggagagcacgtggagatagattctcctccagtcagggagtctgcatttggaaggtgcctctcaggcccctgaataactcatccccagagacagggtttcctcatgttgaatgtgggaatattgatagcacatacctcacctcatctcacatgagatgtgtgtgagaaccgagtgaagtaactgacatggaagcattctcgcaagtgtaagatgtgcaaatgcaagtcatcaggtttagaaagaagactgatggatcccccaccccataccccacacttctccacccaccagagccctgagaaggactcaagtggattttgctcagttgtctgttatgtttcctcctataggacagtggcaagtcactggaccgggcaagtttgtccaggccttggtgggggaggacgccgtgttctcctgctccctctttcctgagaccagtgcagaggctatggaagtgcggttcttcaggaatcagttccatgctgtggtccacctctacagagatggggaagactgggaatctaagcagatgccacagtatcgagggagaactgagtttgtgaaggactccattgcaggggggcgtgtctctctaaggctaaaaaacatcactccctcggacatcggcctgtatgggtgctggttcagttcccagatttacgatgaggaggccacctgggagctgcgggtggcaggtcagttgtttatttatgactgagttgtcttgtaaagtcatgctaccattatcagctcttaaaagtatttcagataatgaaataaaacagactttccagattctgacatgatgtaaaaaggcttcggtggggatcactgacctgaggtttctggagatgagcctggccctgccatcacacaggtgggatcatgatgcagaagacagccacctgcacctgccaccacctgacaggatacagaggaaagccactcccaatgttggtgaaatgagagtgataatgcctgtcatatttcaatttcttttattttcttcttttttcttgacttcttgtgtgttactaaactttttttaggattccatcacaacttattgttagtctttttttagtataacattttgtagtgttttcttaggtgctgctttaggtgttatgatattcatatataatttatcacaatctactatatcaacattttaccactttgaagtgtggaaacttcattttcattcagagcccttcaaactccacaatttaaaaataacattgccttgagtatttcttctatatacataagcactatatcagatagtgacttaatttctgtttaaaccatcatatataattttcatttttattttttattttttatttttctttgagacagtcttgtcccgtcacccaggctggagtgcagtggtgtgatctcagctcactgcaacctccacctcctggattcaagtgactcttgtacctcagcctcctgagtagctcagattacaggcatgcgccaccacacccagctaatttttttttgtatttttagtagagatggggttctgccatgttggccagctggtctcaaactcctggcctcaaatgatcccctgccttgggctcccaaaatgctgggattacaggtgtgagccaccacacccagcacatatgtgattgttaaacactaataaaatggaaaatctattgtagttttccttattcttctttttctattgcttttcttctttcctaatattccaagattctttcttttatcatttcctttctgtttgaagaatttcctccagccatccttttaggataggtctgctagtgacaaattctcttagtttttgtttatctgagaataaatatgcaaaagatttcctctttatttgtgaataatggttttgccagatatagaatttctgagtttcttgatggttattttctttcagcagttgaaaaatgtgctacttctttctggccttgaagatttctcacgaaaaatctgctgtcattggtgttttctttattttcagaaatttaattatgatctatcaaggcatgggtttctttacatttctcctatttggtgtgctctcagcttcttgaatctgtagtttcatgactttcacctcatttgattagatcagccatcatttctttaaatactctttcagctctctctctttctcctctccttctgggactatgatgatataaatgttgatattttgttattgtctcataggtccttgaggatctgtttttccctttaaaaaaatattttcctctcttttcatgctggttaagtttcattgttgtatcctggagttcaataattttttttttttttttatgagatggagtctcgctctgtcgcccaggctggatagagtgcagtggtgcaatctcgctcactgcaagctctgccttccgggttcacgccattctcctgcctcagcctccggagtagctggaactacaggcacctgccaccacgcccggctaattttttttgtatttttagtagagacggggtttcaccgtgttaaccaggatggtcttgatctcctgatctcatgatccacccgccttggcctcccaaagtgctgggattacaggcctgagccaccatgccaggccaataattttattttctgtcatctccactctagcattgaagctacccagttagtttttgtttttgcatttttttctgttatattacttctgatttgttttttataacatctatggtttttgttttttaaattttttgagagaattcataattgctttttgaaacattttaataatagctattcatgttggtcttggcaatcacatgattgtctattttcattcaagttgatatttaattggttcttggtatgatgggtaatttttagttgaaatctaaatggtttaactattgtaagatactctagaccctatgtaaagcttctgttttgcaggcagtcaccatgtttagatttatgactcaggtcctagtctatttttggtggttgtggctccaaatacaatttaattttcagagactttactgtgttattttggtctactttgcttaactgatgtcactggagattctgctcatcctttctagtactaactgtggcagtaaaaggtgttttcccatgttgctcctcactgtttcttgtgagagaggtgatcatctggcatagtgggaaaaagtactcttcccctggtctccagtcaatggggcttatgatcaattcttttgccagcaccactttgtatatcatgtattttcagccatttaggggtggaaagattcccgctgggccacctacttctgctggaggtgggagtgggggagtggtcataggatgctcagctgctgtgttttttttctactcctggggtccctagtcagtcctccttagtctttccacttttcaaaatgcacctatgcttgccgcatttctagggtttatgattttacttagagaaaggagcaaggaagagaagtctacatcatcttacttgagcccccttccttggtgcttacaccaccatcattctttcattaatttattgactaacaaacatttattaggctccatgcactgatccagaccctagggaatgacagagtacaacactcagagaggaagttctgtttggagtggttaaaaggcaatattaaatcataaaattgaagtcaaccacataagaggtacttttgcatatttcccaagtcacaaatctgaatgtcacaataaacccttccttgatgttcagtcctattgattcaacctctcaaatagattctgcacctgccgttccccttctcagagccctcctcctccccagcccttcttttctctcactggagtcacttcagtagttgcatggcgggtcactctcctccggagtgttctctatggtccctcctccatgctgctgcctggagacctctctaacatacaggccttgccataactcccacctgctggaagctggtaagagccttactggtctacagttcttaaagtggctgtgggcaagtccacgttgctcaggtcagtgaaggtatgacctccacggcttgccttgtgcctttttcagatcttgtctcacacccctactctcttatacatcatctggaatataaatattcatgagtccttgaaatcactgtggcatgttaacttttcacattgtggtttgtacttgcctctttttgtctaaaatgcttcccctctcccagacctgaccacaacaaaactcctattttctgacacagaagggtgcaaatgtcatctccaggaagctgtgcctttccctgacagttaagcactcttctctgtgctaacctgaccatgctttcatagttgccatttcactatgaaatgtattttatacagtttcctcactatttgatcaatgagtttctcattagaaggggctgtgtcttattcactgcatcctatttcatacttaggaatatccaggcatatatagtggctgctaaataaatgttgaatgaacatagaccatggaagggcttgcagtagtagcatgagtggatgtgtgtgtaagagagagagagagaaaaagatgtgtgtgtaagagacagagagaaaaggatgtgtgtgtgtgagagagagagagagagaaaaggatgtatgtgtgttatgggtacaggcttgatgaaccagactcaaaatgctgtaagcttgaaatttggtctttgctttcatctttccctgttttcttcccagcactgggctcacttcctctcatttccatcgtgggatatgttgacggaggtatccagttactctgcctgtcctcaggctggttcccccagcccacagccaagtggaaaggtccacaaggacaggatttgtcttcagactccagagcaaatgcagatgggtacagcctgtatgatgtggagatctccattatagtccaggaaaatgctgggagcatattgtgttccatccaccttgctgagcagagtcatgaggtggaatccaaggtattgataggaggtgagtggggagaaggaggagcaaggaatgggtgtgtgcatacgtaacccagggtagagcagcagcttgtgtctgggattgttgtgtagtaccatccagcttcaatgatttgttttgagagtcaaagattgatgaggtataaaaaacaaaaccaaacatttgataaggcagaagtagaatagtttacaatttcaaggcagtagaattaagtatttccttcaccacacaatacccccatggtgcaacactcacaactcaacacgtaacaaaacttaaggaaattaactctaggactaagaaaataattgtttcttcatttttagaaaacgtcgttgctccttcatgaagcagaataaaactgtagaaaatttcagaaaggatttacaaatagtaggaaaatttacataaactaaaatgcttccagaatcacactcaattaaaaggattgaatttgccagttaaaagacaaagaatctcagactggatttaaaaatctcatcgcttgaacccaggaggcagaggttgcagtgagccgagatggcaccactgtgctccagcctgggtggcagagcaagactccatctcaaaaatgtaaaaataaaaataaaaataaaaatagacaaatactaaaaatctcaatggcaattcataagaggaaaaatgtagcacatatgagctattcattgaaaataaaaaatactcgagaaatattaatcacgaagaattgaacagatatattagtgtcaagaaaaggaagacaaagttgtaagaaaaagggcattagggatagagttatttcaaaaacataagttcactcagtataagaatatgaaaattttaaatatatatacatgtaccttatacatgtaaaacatagaaaatatcaacagaaataagaaaaaaggtcatacttcgagttctaaaattgattaaataagtagacaaaatgagtaagaatatatactatttgaactaaaaattaataagtctgaaataacgtatttttggagatggcactccaggtttgtagaatatacattaatttttaccacacttggaacttttataaaattttaccagatataaacacatacaatggttttaagaaaattttcagacatagatatcatgcacatgaaattctctaatcataatttaataaagtcaaatgaccacagcaaaagatagtttaaattcttatgtgtttgaaaaatttttaaacattaaaataactgagaaattgaagaaagcatagtgataggtagaaaattcttaaaactgaatgataataaaattacaatctatcataatgtgtaaaatagaactaatatagttttctgagtcaaaattttatctggccgggcgcagtggctcacgcctgtaatcccagcactttggaaggccaagacaggcggatcacctgaggtcaggagttcaagaccagcctggccataatggtgaaaccccgtctctactaaaaatacaaaaattagccgggtgtggtggcgggtgcctgtaatcccagctacctgggaagctgaggcaggagaattgcttgaacccgggaggcggaggttgcggtgagccgagatcatgccactgcactccagcctgggcgatagagcaagactccatctcaaaaatatatatatatatatcctttaatgcttaaatgttcttattagcatgaaatagctgaatattgatattaggcatcaatatatatttcagaaaacagcaaaagaaagtggaagaaatcctaaagatatagaaatatggaaatataaagacaaatagtgcacattaatacatctaaagttagacggttcgaagtgttattaaaatagataaactggcaacatcagttaagaataaaagagaaacagcacaattaaacaaggcaggaaataacaagaaggcacaactaaagatttagtagagatttgtaagataaactgctttgaataactttttccttttctattgaatatgatgaagtgaaagttttcatagaaaaatgtaaaatacaggacaggcgcagtggctcatgcctgtagtcccagcagtgtggaaggctgaggcgggcagatcgcttgaggtcaggagtttgagaccagcctgcccaacatggcgaaaccccatctctactaaaaatacaaaaattagctgggcgtggtggtgtgtgtctgtaatcccagctactctggaggctgaggctggagaatcacttaaatccaggagacagagattgcagtgagctgagatcgccccactgtactccagcctgggggacagagtgagactttgtctcaaaaatttttaaaaaagaagaaaaacgtaaaatacaaaatccgaaggaaagatagactacctgactaatttgtaaccatgaaagaggtggactcagcatttaaaagtcttcccacaaggaagacacaaggcccacattgttttatatacaaagtctaccaaatattcaagaaaagagaaaatgtatctttcagaaagtcggccagagagcagaaaaataggaaatattaaactcattttattgagtcaacataattttggtatcataagagaaatgggcaattcaaaaaaggaaaaatttttaccaacattactcataattgaaaatgtaaaaatcttaccaaaaattttgcaagtagaaaagtccacaaaaacatatatcatgaccaaacttatcctggaaaaaaatgttaggtcaacatgggaacatatattaatgtaattataacataattcgttaaaagagataaactataattttcttagtagatgtaaataaaacagataactttctacatctattcatcatgatttcaacacttgcaaatctagaaatagaagaaaattttttttatcaatctagaaataggagagactctgcttaatctgataaaaagatatctaaagatacttgcagcaaacatcatacaaaataataagccacctaattttttaaatacataccgaaaacattatacataatgtgtcatttaaaatcataacataggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaataaaataaaataaaaaaataaaataaaataaaataaaatcataacataaggagattgcattaaacacttctgttccacattatattagagtactgttactattagcagccacttcaataagggaagaaaatgtaaaagttataacttttagaaagaaaaaaattaaatggccattgttcacagtttatatgatgatataaacggaaaatttagaaaaatttacagacaaattctttcaactcataaaggaatccatcgtgttcatgaaaaatgagaggaataaacaaaatctaataaaatgtttacaaaatcttattgaagggtattataaaactgtattaaaagacactaatgaaaactaaaataagagaacaaacataacacctttcagataagaagatgcatgtttttaaagataccagttctcctagaattgctgtacagattcaatacaattccatagaaaaatctcagcacattttttggtttgtttgttttttgagatgagctgtcactctgtcacccatgctggagtatagtggtgcaatcatggctcattgcaacctcaatttcccatgctcaagcaatcctcccacctcagcctcccaagtagctgggaccacaggtgtgcaccaccatgcctggctaattttttttaattttaaatatttttatagatgggggggggtctcactttgttgcctagactggtctcgaactcctgtccttaagaaatcctcccggccaggcgcggtggctcatgcctgtaatcccagcactttgggaggccgagacgggaggatcacgaggttaggagatcgagaccatcctggctaacatggtgaaaccccatctctactaaaaatacaaaaaattagctaggcgtggtggcgggcgcctgtagtcccagccactcaggaggctgaggaaggagaatggcgtgaacccgggaggcagaggttgcagtgagccgagatcgcgccactgcactcctccctgggcaacagagcgagactctgtctcaacaaaacaaaacaaaacaaaacaaaacaaagaaatctaaaggagaaaagaataaacattacctttaaaaaaaaaaagaaatcctcccactttggcctcccaaactgctgggtttataggcatgagccactgcacctggcccagagttttcttaaagcctaacaagtcaattccaaagtttatgtggcaaaacaaatagccaagaattgctaagatacagtggaataagagcaagctaagaagcttagtcttatctcagagacatatcccaaagctttgaagattaagccaattaaaattattggcacagagataaccctatggatcaatgagagagaacaaagagcccagaaacaaatccaagcttgaacatgaggtacacagaggtgaccttgcatgtgtggcagtgtgtaaagcaaggtccactcaacaaacattgccagcacagtcaacacctgcttagaagaagatgacattgaacttctgcctcattagacatagacacacacacacacacacacacgtgtgtgtgtatatatatatatatatatatatatatgaaatccagatggatcaagacttataaagaaatgcaaagctttaacgcgcacacacacacacacgtgaatatatatatatatatatatatatatatatatatgaaatccggatggatcaagatgtttatagaaatgcaaagctttaaatctgtggaagaaatgagagaaaaatgttttcatcttggggtactgggggattccttaaatgggcgtaaaattgtcttacctgcttagctatcactaagggtctgtgggactgtttttcagagacgtttttccagccctcaccttggcgcctggcttctattttactcgggttactctgtggtgccctgtgtggtgttgtcatggggatgataattgttttcttcaaatccaaaggtaagtgagagagagaagcatgggcccataccttcttcatggttccagtggagctgatatcaggctgccctcacacacctctgggctctgctcttccagccctaggcctacaggggccaccagctgaggcacagggaacccagtcttcagcctcctctgtgctggcctgaaatggctccttcagaaaatgccagcctctgccaatccctttctactttacatggagcacaggataagcagataattgattttcagtacataaagagttcacataaatttctaccaacaggctgagtgccgtggctcgtgtctgtaatcccagcactttgggaggccgatgtgggaggatcacttgagcccaggagtgtaagaccatcctgggcaacatggcgagaactcctctctacaaaaaatttttaaaaaataaaataaaataattagctgggtgtggtggtgcgtgactgtggtcccagctacttaggaggttgagatgggaggatggcttgagcacaggaggtcaaggctttagtgagccatgttcgcaccactgcacatcagcctgggcaacagagtgagaccctgactcaataaataaatatataaaaataaataaatttctactaacgacaacaagagacaataagaaaatttcagggtggttgcaaagacttcatagaagaggaaataaaactgactgactgagataaaatgataatctcagtaagagtcttcaccctagaacaaatttcctcctccttgggagtgacacttccccttgggggtgaggccacccccgcctcccctcccagccgccttctcccatctccatccccacctccacagcatcccagctgttgtccctctccttagcatgcaccttcctgatctcttgctccaccccagagagccacactccgtgcaggggctggggagacgagcacatataagtgtcctaggagaggccctgcccttcacacctgcagctcgtcccacctgtgcaaggagccagcgtcgtgtttgtaccttgcacactcctgtgtccaccactgaatatactgtttctgtttcagggaaaatccaggcggaactgggtatgtgtcatgtcctgagcctcccacacatggttctcccgggtccctccctgatccacagtttgagcctctggacgaccctggctgcaggctggacaggaagcaccggcaggtggaggggagcagctgctcactctctccatccactgctcatgagttacccctcggacatctggagggcttaggataggccccggggcctggaagtccccacaaattgtctgtgcctgttgcccgttggtttgctgtgtgtgtggtggggggaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcagatctctggagggtccacaacactcaaaaagggtcccaatccttggtctttcccttctccctgcgccctgtttcccacgtgagcacggaactgcctgctctctctgcttgctttcagaattgagagacgcccggaaacacgcaggtaccaacgcctgagagggtaacagtgggcatggagtaggaagatgaccagtgacagatatggagcccatccagcttgtagacagcaaatctgtgatgcccgaatccaccccagggtgcagctgcctctaaatacacttcttggcccaggacttggagggaaaagcgtagggactgggtcagctaggaggggtcacaggcaagacgccagggaactgagggcattagtagctggcttctaggggtctgtgcaaaggggaactaagtgaagttagcaggaactggtgggtggaaggaagctgaatcctggagtcactcaaggtctcacaaagtcaaatagagggcttacgtgggagggcagtggtagggctgggtgaacatctcatggttgagcatctccaagcatcagtgaggcacgggggctgccctggagaaggtacatggctggtgggatagtgggactggccggatcctacccggagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagggtttccaagcagggaaacattactgggaggtggacgtgggacaaaatgtagggtggtatgtgggagtgtgtcgggatgacgtagacagggggaagaacaatgtgactttgtctcccaacaatgggtattgggtcctcagactgacaacagaacatttgtatttcacattcaatccccattttatcagcctcccccccagcacccctcctacacgagtaggggtcttcctggactatgagggtgggaccatctccttcttcaatacaaatgaccagtcccttatttataccctgctgacatgtcagtttgaaggcttgttgagaccctatatccagcatgcgatgtatgacgaggaaaaggggactcccatattcatatgtccagtgtcctggggatgagacagagaagaccctgcttaaagggccccacaccacagacccagacacagccaagggagagtgctcccgacaggtggccccagcttcctctccggagcctgcgcacagagagtcacgccccccactctcctttagggagctgaggttcttctgccctgagccctgcagcagcggcagtcacagcttccagatgaggggggattggcctgaccctgtgggagtcagaagccatggctgccctgaagtggggacggaatagactcacattaggtttagtttgtgaaaactccatccagctaagcgatcttgaacaagtcacaacctcccaggctcctcatttgctagtcacggacagtgattcctgcctcacaggtgaagattaaagagacaacgaatgtgaatcatgcttgcaggtttgagggcacagtgtttgctaatgatgtgtttttatattatacattttcccaccataaactctgtttgcttattccacattaat
